US012624087B2

(12) United States Patent
Swanson et al.

(10) Patent No.: US 12,624,087 B2
(45) Date of Patent: May 12, 2026

(54) CD155 VARIANT IMMUNOMODULATORY PROTEINS AND USES THEREOF

(71) Applicant: ALPINE IMMUNE SCIENCES, INC., Seattle, WA (US)

(72) Inventors: Ryan Swanson, Seattle, WA (US); Michael Kornacker, Seattle, WA (US); Daniel William Demonte, Seattle, WA (US); Mark F. Maurer, Seattle, WA (US)

(73) Assignee: Alpine Immune Sciences, Inc., Seattle, WA (US)

( * ) Notice: Subject to any disclaimer, the term of this patent is extended or adjusted under 35 U.S.C. 154(b) by 278 days.

(21) Appl. No.: 18/046,859

(22) Filed: Oct. 14, 2022

(65) Prior Publication Data

US 2023/0381229 A1 Nov. 30, 2023

Related U.S. Application Data

(62) Division of application No. 16/320,981, filed as application No. PCT/US2017/044261 on Jul. 27, 2017, now Pat. No. 11,471,488.

(60) Provisional application No. 62/475,196, filed on Mar. 22, 2017, provisional application No. 62/472,558, filed on Mar. 16, 2017, provisional application No. 62/410,839, filed on Oct. 20, 2016, provisional application No. 62/394,696, filed on Sep. 14, 2016, provisional application No. 62/367,822, filed on Jul. 28, 2016.

(51) Int. Cl.
| | |
|---|---|
| *C07K 14/705* | (2006.01) |
| *A61K 35/17* | (2025.01) |
| *A61K 40/10* | (2025.01) |
| *A61K 40/11* | (2025.01) |
| *A61K 40/24* | (2025.01) |
| *A61K 40/42* | (2025.01) |
| *A61K 40/50* | (2025.01) |
| *A61P 35/00* | (2006.01) |
| *C07K 14/735* | (2006.01) |
| *C07K 16/28* | (2006.01) |
| *C12N 15/62* | (2006.01) |
| *C12N 15/85* | (2006.01) |

(52) U.S. Cl.
CPC ........ *C07K 14/70596* (2013.01); *A61K 35/17* (2013.01); *A61K 40/10* (2025.01); *A61K 40/11* (2025.01); *A61K 40/24* (2025.01); *A61K 40/42* (2025.01); *A61K 40/421* (2025.01); *A61P 35/00* (2018.01); *C07K 14/70532* (2013.01); *C07K 14/70535* (2013.01); *C07K 16/28* (2013.01); *C12N 15/62* (2013.01); *C12N 15/85* (2013.01); *A61K 40/50* (2025.01)

(58) Field of Classification Search
None
See application file for complete search history.

(56) References Cited

U.S. PATENT DOCUMENTS

| | | | |
|---|---|---|---|
| 4,751,180 | A | 6/1988 | Cousens et al. |
| 4,935,233 | A | 6/1990 | Bell et al. |
| 5,168,062 | A | 12/1992 | Stinski |
| 5,208,020 | A | 5/1993 | Chari et al. |
| 5,283,173 | A | 2/1994 | Fields et al. |
| 5,385,839 | A | 1/1995 | Stinski |
| 5,434,131 | A | 7/1995 | Linsley et al. |
| 5,443,964 | A | 8/1995 | Pickup et al. |
| 5,457,035 | A | 10/1995 | Baum et al. |
| 5,468,614 | A | 11/1995 | Fields et al. |
| 5,500,362 | A | 3/1996 | Robinson et al. |
| 5,624,821 | A | 4/1997 | Winter et al. |
| 5,641,870 | A | 6/1997 | Rinderknecht et al. |
| 5,648,260 | A | 7/1997 | Winter et al. |
| 5,698,530 | A | 12/1997 | Schlom et al. |
| 5,716,613 | A | 2/1998 | Guber et al. |
| 5,716,826 | A | 2/1998 | Gruber et al. |
| 5,731,168 | A | 3/1998 | Carter et al. |
| 5,767,071 | A | 6/1998 | Palladino et al. |
| 5,773,253 | A | 6/1998 | Linsley et al. |
| 5,780,426 | A | 7/1998 | Palladino et al. |
| 5,821,337 | A | 10/1998 | Carter et al. |
| 5,844,095 | A | 12/1998 | Linsley et al. |
| 5,851,529 | A | 12/1998 | Guber et al. |
| 5,851,795 | A | 12/1998 | Linsley et al. |
| 5,885,796 | A | 3/1999 | Linsley et al. |
| 5,891,432 | A | 4/1999 | Hoo |
| 5,942,607 | A | 8/1999 | Freeman et al. |
| 5,998,205 | A | 12/1999 | Hallenbeck et al. |

(Continued)

FOREIGN PATENT DOCUMENTS

| | | |
|---|---|---|
| CN | 103987405 A | 8/2014 |
| CN | 105579471 A | 5/2016 |

(Continued)

OTHER PUBLICATIONS

U.S. Appl. No. 18/346,092, filed Jun. 30, 2023, by Swanson et al. (Copy not submitted herewith pursuant to the waiver of 37 C.F. R. § 1.98(a)(2)(iii) issued by the Office on Oct. 19, 2004).
U.S. Appl. No. 18/494,677, filed Oct. 25, 2023, by Swanson et al. (Copy not submitted herewith pursuant to the waiver of 37 C.F. R. § 1.98(a)(2)(iii) issued by the Office on Oct. 19, 2004).
"Database accession No. A9UFX3," version 38. Retrieved from Uniprot, http://www.uniprot.org/uniprot/A9UFX3.txt. Retrieved on Jan. 18, 2018.

(Continued)

*Primary Examiner* — Ruixiang Li
(74) *Attorney, Agent, or Firm* — McNeill PLLC

(57) ABSTRACT

Provided herein are immunomodulatory proteins comprising variant CD155 and nucleic acids encoding such proteins. The immunomodulatory proteins provide therapeutic utility for a variety of immunological and oncological conditions. Compositions and methods for making and using such proteins are provided.

22 Claims, 11 Drawing Sheets

Specification includes a Sequence Listing.

(56)          References Cited

U.S. PATENT DOCUMENTS

| | | | |
|---|---|---|---|
| 6,084,067 A | 7/2000 | Freeman et al. | |
| 6,130,316 A | 10/2000 | Freeman et al. | |
| 6,143,290 A | 11/2000 | Zhang et al. | |
| 6,194,551 B1 | 2/2001 | Idusogie et al. | |
| 6,218,510 B1 | 4/2001 | Sharpe et al. | |
| 6,294,660 B1 | 9/2001 | Sharpe et al. | |
| 6,352,694 B1 | 3/2002 | June et al. | |
| 6,365,619 B1 | 4/2002 | Shi | |
| 6,428,968 B1 | 8/2002 | Molnar-Kimber et al. | |
| 6,444,792 B1 | 9/2002 | Gray et al. | |
| 6,482,919 B2 | 11/2002 | Ledbetter et al. | |
| 6,534,055 B1 | 3/2003 | June et al. | |
| 6,596,535 B1 | 7/2003 | Carter | |
| 6,623,940 B1 | 9/2003 | Ledbetter et al. | |
| 6,632,670 B1 | 10/2003 | Wadsworth et al. | |
| 6,635,472 B1 | 10/2003 | Lauermann | |
| 6,635,750 B1 | 10/2003 | Coyle et al. | |
| 6,641,809 B1 | 11/2003 | Linsley et al. | |
| 6,653,103 B2 | 11/2003 | Peterson et al. | |
| 6,685,941 B1 | 2/2004 | Thompson et al. | |
| 6,689,871 B1 | 2/2004 | Wolfe et al. | |
| 6,713,279 B1 | 3/2004 | Short | |
| 6,723,316 B2 | 4/2004 | Laquerre et al. | |
| 6,730,512 B2 | 5/2004 | Chang | |
| 6,737,056 B1 | 5/2004 | Presta | |
| 6,855,317 B2 | 2/2005 | Koelle et al. | |
| 6,887,471 B1 | 5/2005 | Linsley et al. | |
| 6,897,045 B2 | 5/2005 | Engelhardt et al. | |
| 6,936,257 B1 | 8/2005 | Bennett | |
| 6,998,252 B1 | 2/2006 | Moss et al. | |
| 7,001,765 B2 | 2/2006 | Maass et al. | |
| 7,033,826 B2 | 4/2006 | Perricaudet et al. | |
| 7,094,874 B2 | 8/2006 | Peach et al. | |
| 7,094,875 B2 | 8/2006 | Punnonen et al. | |
| 7,125,717 B2 | 10/2006 | Carter | |
| 7,153,510 B1 | 12/2006 | Rose | |
| 7,172,893 B2 | 2/2007 | Rabinowitz et al. | |
| 7,238,526 B2 | 7/2007 | Wilson et al. | |
| 7,241,447 B1 | 7/2007 | Engelhardt et al. | |
| 7,247,615 B2 | 7/2007 | Schlom et al. | |
| 7,304,033 B2 | 12/2007 | Larsen et al. | |
| 7,307,064 B2 | 12/2007 | Rusnak | |
| 7,332,303 B2 | 2/2008 | Schilling et al. | |
| 7,332,581 B2 | 2/2008 | Presta | |
| 7,368,116 B2 | 5/2008 | Schlom et al. | |
| 7,371,826 B2 | 5/2008 | Presta | |
| 7,378,087 B2 | 5/2008 | Jefferies et al. | |
| 7,446,189 B1 | 11/2008 | Weiner et al. | |
| 7,455,835 B2 | 11/2008 | Cohen et al. | |
| 7,482,327 B2 | 1/2009 | Hagerty et al. | |
| 7,521,532 B2 | 4/2009 | Dunussi-Joannopoulos et al. | |
| 7,537,924 B2 | 5/2009 | Coffin | |
| 7,550,296 B2 | 6/2009 | Hermiston et al. | |
| 7,560,540 B2 | 7/2009 | Pardoll et al. | |
| 7,563,869 B2 | 7/2009 | Honjo et al. | |
| 7,569,663 B2 | 8/2009 | Tykocinski et al. | |
| 7,588,767 B2 | 9/2009 | Szalay et al. | |
| 7,588,771 B2 | 9/2009 | Szalay et al. | |
| 7,612,170 B2 | 11/2009 | Punnonen et al. | |
| 7,619,078 B2 | 11/2009 | Sharpe et al. | |
| 7,655,439 B2 | 2/2010 | Moore et al. | |
| 7,662,398 B2 | 2/2010 | Szalay et al. | |
| 7,662,627 B2 | 2/2010 | Johnson et al. | |
| 7,670,602 B2 | 3/2010 | Chung et al. | |
| 7,671,022 B2 | 3/2010 | Rusnak | |
| 7,709,214 B2 | 5/2010 | Freeman et al. | |
| 7,722,868 B2 | 5/2010 | Freeman et al. | |
| 7,731,952 B2 | 6/2010 | Mohr et al. | |
| 7,731,974 B2 | 6/2010 | Bell et al. | |
| 7,754,221 B2 | 7/2010 | Szalay et al. | |
| 7,794,718 B2 | 9/2010 | Karrer et al. | |
| 7,811,814 B2 | 10/2010 | Bohn et al. | |
| 7,897,146 B2 | 3/2011 | Brown et al. | |
| 7,906,111 B2 | 3/2011 | Wilson et al. | |
| 7,927,585 B2 | 4/2011 | Snyder | |
| 7,943,374 B2 | 5/2011 | Hildinger | |
| 7,968,340 B2 | 6/2011 | Hallek et al. | |
| 8,007,780 B2 | 8/2011 | Arbetman et al. | |
| 8,053,414 B2 | 11/2011 | Pardoll et al. | |
| 8,053,558 B2 | 11/2011 | Pardoll et al. | |
| 8,088,736 B2 | 1/2012 | Franks et al. | |
| 8,148,332 B2 | 4/2012 | Cohen et al. | |
| 8,202,847 B2 | 6/2012 | Weiner et al. | |
| 8,329,867 B2 | 12/2012 | Lazar et al. | |
| 8,435,952 B2 | 5/2013 | Vratsanos et al. | |
| 8,445,447 B2 | 5/2013 | Chen | |
| 8,609,625 B2 | 12/2013 | Lan et al. | |
| 8,624,010 B1 | 1/2014 | Yoshinaga | |
| 8,629,119 B2 | 1/2014 | Olson et al. | |
| 8,709,417 B2 | 4/2014 | Allison et al. | |
| 8,911,726 B2 | 12/2014 | Takahashi et al. | |
| 8,956,619 B2 | 2/2015 | Ostrand-Rosenberg | |
| 9,029,315 B2 | 5/2015 | Chen et al. | |
| 9,103,831 B2 | 8/2015 | O'Sullivan et al. | |
| 9,327,014 B2 | 5/2016 | Gurney et al. | |
| 9,453,227 B2 | 9/2016 | Diamond et al. | |
| 9,540,426 B2 | 1/2017 | Jing et al. | |
| 9,650,429 B2 | 5/2017 | Ostrand-Rosenberg | |
| 9,709,568 B2 | 7/2017 | Pierce et al. | |
| 9,758,565 B2 | 9/2017 | Peach et al. | |
| 9,834,604 B2 | 12/2017 | Zhu et al. | |
| 9,884,902 B2 | 2/2018 | Minter et al. | |
| 10,487,147 B2 | 11/2019 | Nastri et al. | |
| 10,882,914 B2 | 1/2021 | Swanson et al. | |
| 11,078,282 B2 | 8/2021 | Swanson et al. | |
| 11,096,988 B2 | 8/2021 | Swanson et al. | |
| 11,117,948 B2 | 9/2021 | Swanson et al. | |
| 11,117,949 B2 | 9/2021 | Swanson et al. | |
| 11,117,950 B2 | 9/2021 | Swanson et al. | |
| 11,230,588 B2 | 1/2022 | Swanson et al. | |
| 11,319,359 B2 | 5/2022 | Swanson et al. | |
| 11,359,022 B2 | 6/2022 | Swanson et al. | |
| 11,471,488 B2 | 10/2022 | Swanson et al. | |
| 11,479,609 B2 | 10/2022 | Swanson et al. | |
| 11,498,967 B2 | 11/2022 | Swanson et al. | |
| 11,639,375 B2 | 5/2023 | Swanson et al. | |
| 11,732,022 B2 | 8/2023 | Swanson et al. | |
| 11,753,458 B2 | 9/2023 | Evans et al. | |
| 11,834,490 B2 | 12/2023 | Swanson et al. | |
| 12,358,969 B2 | 7/2025 | Evans et al. | |
| 2002/0009454 A1 | 1/2002 | Boone et al. | |
| 2002/0168714 A1 | 11/2002 | Barbas et al. | |
| 2003/0083246 A1 | 5/2003 | Cohen et al. | |
| 2003/0138881 A1 | 7/2003 | Punnonen et al. | |
| 2003/0158102 A1 | 8/2003 | Chen et al. | |
| 2003/0171551 A1 | 9/2003 | Rosenblatt et al. | |
| 2003/0232323 A1 | 12/2003 | Freeman et al. | |
| 2004/0009604 A1 | 1/2004 | Zhang et al. | |
| 2004/0063094 A1 | 4/2004 | Coffin et al. | |
| 2004/0072283 A1 | 4/2004 | Seed et al. | |
| 2004/0146488 A1 | 7/2004 | Hu et al. | |
| 2005/0014934 A1 | 1/2005 | Hinton et al. | |
| 2005/0220818 A1 | 10/2005 | Lorence | |
| 2005/0260601 A1 | 11/2005 | Whitt et al. | |
| 2006/0024298 A1 | 2/2006 | Lazar et al. | |
| 2006/0039894 A1 | 2/2006 | Mohr et al. | |
| 2006/0286093 A1 | 12/2006 | Gross et al. | |
| 2007/0098743 A1 | 5/2007 | Bell et al. | |
| 2007/0110720 A1 | 5/2007 | Brown et al. | |
| 2007/0202572 A1 | 8/2007 | Szalay et al. | |
| 2007/0212727 A1 | 9/2007 | Szalay et al. | |
| 2009/0010889 A1 | 1/2009 | Brown et al. | |
| 2009/0053244 A1 | 2/2009 | Chen et al. | |
| 2009/0098529 A1 | 4/2009 | Chen et al. | |
| 2009/0117034 A1 | 5/2009 | Chen et al. | |
| 2009/0136917 A1 | 5/2009 | Szalay et al. | |
| 2009/0155287 A1 | 6/2009 | Chen et al. | |
| 2009/0162288 A1 | 6/2009 | Chen et al. | |
| 2009/0215147 A1 | 8/2009 | Zhang et al. | |
| 2009/0252749 A1 | 10/2009 | Leister et al. | |
| 2009/0258031 A1 | 10/2009 | Karrer et al. | |
| 2009/0274728 A1 | 11/2009 | Brown et al. | |
| 2009/0285860 A1 | 11/2009 | Martuza et al. | |
| 2010/0062016 A1 | 3/2010 | Szalay et al. | |

(56) References Cited

U.S. PATENT DOCUMENTS

| | | |
|---|---|---|
| 2010/0092515 A1 | 4/2010 | Conner et al. |
| 2010/0113567 A1 | 5/2010 | Barber |
| 2010/0136549 A1 | 6/2010 | Christiansen et al. |
| 2010/0172877 A1 | 7/2010 | Van Den Pol et al. |
| 2010/0178276 A1 | 7/2010 | Sadelain et al. |
| 2010/0178684 A1 | 7/2010 | Woo et al. |
| 2010/0196325 A1 | 8/2010 | Szalay et al. |
| 2010/0233078 A1 | 9/2010 | Szalay et al. |
| 2010/0261660 A1 | 10/2010 | Punnonen et al. |
| 2011/0002956 A1 | 1/2011 | Weiner et al. |
| 2011/0064650 A1 | 3/2011 | Szalay |
| 2011/0064763 A1 | 3/2011 | Allen et al. |
| 2011/0158948 A1 | 6/2011 | Brown et al. |
| 2011/0159023 A1 | 6/2011 | Langermann |
| 2011/0177032 A1 | 7/2011 | Martuza |
| 2011/0195068 A1 | 8/2011 | Langermann et al. |
| 2011/0212530 A1 | 9/2011 | Baltimore et al. |
| 2011/0293705 A1 | 12/2011 | Irvine et al. |
| 2011/0305712 A1 | 12/2011 | Akamatsu et al. |
| 2013/0017199 A1 | 1/2013 | Langermann |
| 2013/0149305 A1 | 6/2013 | Ostrand-Rosenberg |
| 2013/0287748 A1 | 10/2013 | June et al. |
| 2013/0319861 A1 | 12/2013 | Khandros et al. |
| 2014/0011370 A1 | 1/2014 | Camphausen et al. |
| 2014/0050708 A1 | 2/2014 | Powell et al. |
| 2014/0056890 A1 | 2/2014 | Gurney et al. |
| 2014/0099309 A1 | 4/2014 | Powell et al. |
| 2014/0113370 A1 | 4/2014 | Camphausen et al. |
| 2014/0154216 A1 | 6/2014 | Coffin |
| 2014/0186380 A1 | 7/2014 | Gurney |
| 2014/0186401 A1 | 7/2014 | Diamond et al. |
| 2014/0227237 A1 | 8/2014 | June et al. |
| 2014/0308299 A1 | 10/2014 | Allison et al. |
| 2014/0322129 A1 | 10/2014 | Leong et al. |
| 2014/0348832 A1 | 11/2014 | Zhu et al. |
| 2015/0104451 A1 | 4/2015 | Orban |
| 2015/0216970 A1 | 8/2015 | Grogan et al. |
| 2015/0232532 A1 | 8/2015 | Ostrand-Rosenberg |
| 2015/0266958 A1 | 9/2015 | Hermans et al. |
| 2015/0355184 A1 | 12/2015 | Pierce et al. |
| 2015/0359909 A1 | 12/2015 | O'Sullivan et al. |
| 2016/0009805 A1 | 1/2016 | Kowanetz et al. |
| 2016/0017018 A1 | 1/2016 | Wang et al. |
| 2016/0017041 A1 | 1/2016 | Violette et al. |
| 2016/0145344 A1 | 5/2016 | Akbari |
| 2016/0158318 A1 | 6/2016 | Cohen et al. |
| 2016/0244524 A1 | 8/2016 | Allison et al. |
| 2016/0264643 A1 | 9/2016 | Lazar et al. |
| 2016/0271218 A1 | 9/2016 | Biro |
| 2016/0339066 A1 | 11/2016 | Szalay et al. |
| 2016/0340422 A1 | 11/2016 | Chen et al. |
| 2016/0346368 A1 | 12/2016 | Gurney et al. |
| 2016/0347849 A1 | 12/2016 | Cai et al. |
| 2016/0376346 A1 | 12/2016 | Camphausen et al. |
| 2017/0028040 A1 | 2/2017 | Lan et al. |
| 2017/0042972 A1 | 2/2017 | Karyekar |
| 2017/0081387 A1 | 3/2017 | Cai et al. |
| 2017/0145071 A1 | 5/2017 | Brennan et al. |
| 2017/0189476 A1 | 7/2017 | Sung et al. |
| 2017/0226181 A1 | 8/2017 | Ostrand-Rosenberg |
| 2017/0253654 A1 | 9/2017 | Nastri et al. |
| 2017/0285037 A1 | 10/2017 | Kulangara et al. |
| 2017/0320959 A1 | 11/2017 | Swanson et al. |
| 2017/0369549 A1 | 12/2017 | Peach et al. |
| 2018/0118805 A1 | 5/2018 | Bernett et al. |
| 2018/0244749 A1 | 8/2018 | Swanson et al. |
| 2018/0256644 A1 | 9/2018 | Swanson et al. |
| 2018/0319861 A1 | 11/2018 | Lan et al. |
| 2019/0135922 A1 | 5/2019 | Swanson et al. |
| 2019/0175654 A1 | 6/2019 | Swanson et al. |
| 2020/0040059 A1 | 2/2020 | Swanson et al. |
| 2020/0283500 A1 | 9/2020 | Evans et al. |
| 2020/0308249 A1 | 10/2020 | Evans et al. |
| 2021/0130436 A1 | 5/2021 | Swanson et al. |
| 2021/0130437 A1 | 5/2021 | Swanson et al. |
| 2021/0155668 A1 | 5/2021 | Swanson et al. |
| 2021/0155669 A1 | 5/2021 | Swanson et al. |
| 2021/0163571 A1 | 6/2021 | Swanson et al. |
| 2021/0171603 A1 | 6/2021 | Swanson et al. |
| 2021/0188942 A1 | 6/2021 | Swanson et al. |
| 2021/0253668 A1 | 8/2021 | Swanson et al. |
| 2021/0347897 A1 | 11/2021 | Swanson et al. |
| 2021/0363216 A1 | 11/2021 | Bossi et al. |
| 2021/0363219 A1 | 11/2021 | Swanson et al. |
| 2022/0177587 A1 | 6/2022 | Swanson et al. |
| 2022/0242930 A1 | 8/2022 | Swanson et al. |
| 2022/0372106 A1 | 11/2022 | Swanson et al. |
| 2023/0101432 A1 | 3/2023 | Swanson |
| 2023/0136723 A1 | 5/2023 | Swanson et al. |
| 2023/0220039 A1 | 7/2023 | Swanson et al. |
| 2023/0241168 A1 | 8/2023 | Dillon et al. |
| 2023/0250152 A1 | 8/2023 | Evans et al. |
| 2023/0381229 A1 | 11/2023 | Swanson et al. |
| 2024/0002466 A1 | 1/2024 | Swanson et al. |
| 2024/0158463 A1 | 5/2024 | Evans et al. |

FOREIGN PATENT DOCUMENTS

| | | |
|---|---|---|
| EP | 0757099 | 2/1997 |
| EP | 1173204 A1 | 1/2002 |
| EP | 1248802 A2 | 10/2002 |
| EP | 1385466 | 2/2004 |
| EP | 1391213 | 2/2004 |
| EP | 1520175 | 4/2005 |
| EP | 1606411 | 12/2005 |
| EP | 1870459 A1 | 12/2007 |
| EP | 3020816 | 5/2016 |
| JP | H09202800 A | 8/1997 |
| JP | 2004513878 A | 5/2004 |
| JP | 2010533649 A | 10/2010 |
| JP | 2020509776 A | 4/2020 |
| WO | 9310151 A1 | 5/1993 |
| WO | 9411026 A2 | 5/1994 |
| WO | WO-1994/029351 | 12/1994 |
| WO | WO-1998/050431 | 11/1998 |
| WO | WO-1999/002711 | 1/1999 |
| WO | WO-1999/038955 | 8/1999 |
| WO | WO-1999/051642 | 10/1999 |
| WO | 0040716 A2 | 7/2000 |
| WO | WO-2000/042072 | 7/2000 |
| WO | WO-2001/030843 | 5/2001 |
| WO | 0192337 A2 | 12/2001 |
| WO | WO-2002/000717 | 1/2002 |
| WO | 20020019898 A2 | 3/2002 |
| WO | 02091997 A2 | 11/2002 |
| WO | WO-2003/002722 | 1/2003 |
| WO | 2004003562 A2 | 1/2004 |
| WO | WO-2004/029197 | 4/2004 |
| WO | WO-2004/030636 | 4/2004 |
| WO | WO-2004/056312 | 7/2004 |
| WO | 2004085658 A1 | 10/2004 |
| WO | WO-2005/063816 | 7/2005 |
| WO | WO-2005/100402 | 10/2005 |
| WO | WO-2006/019447 | 2/2006 |
| WO | WO-2006/029879 | 3/2006 |
| WO | 2006073941 A2 | 7/2006 |
| WO | 2007029879 A1 | 3/2007 |
| WO | WO-2007/052029 | 5/2007 |
| WO | 2007134326 A2 | 11/2007 |
| WO | WO-2008/011636 | 1/2008 |
| WO | 2008047150 A2 | 4/2008 |
| WO | WO-2008/092117 | 7/2008 |
| WO | 2008155134 A1 | 12/2008 |
| WO | 2008157369 A2 | 12/2008 |
| WO | WO-2009/029342 | 3/2009 |
| WO | WO-2009/067800 | 6/2009 |
| WO | WO-2009/076524 | 6/2009 |
| WO | WO-2009/105671 | 8/2009 |
| WO | WO-2009/126688 | 10/2009 |
| WO | 2010027423 A2 | 3/2010 |
| WO | 2010027828 A2 | 3/2010 |
| WO | WO-2010/027827 | 3/2010 |
| WO | WO-2011/020024 | 2/2011 |
| WO | WO-2011/056983 | 5/2011 |

(56) References Cited

FOREIGN PATENT DOCUMENTS

| | | |
|---|---|---|
| WO | 2011066342 A2 | 6/2011 |
| WO | 2011097477 A1 | 8/2011 |
| WO | WO-2011/103584 | 8/2011 |
| WO | 2011109280 A1 | 9/2011 |
| WO | 2011109789 A2 | 9/2011 |
| WO | WO-2011/113019 | 9/2011 |
| WO | WO-2011/133886 | 10/2011 |
| WO | WO-2012/079000 | 6/2012 |
| WO | WO-2012/125850 | 9/2012 |
| WO | WO-2012/140627 | 10/2012 |
| WO | WO-2012/141984 | 10/2012 |
| WO | WO-2012/149364 | 11/2012 |
| WO | WO-2013/003761 | 1/2013 |
| WO | 2013041029 A1 | 3/2013 |
| WO | WO-2013/079174 | 6/2013 |
| WO | WO-2013/130683 | 9/2013 |
| WO | 2013148049 A1 | 10/2013 |
| WO | WO-2013/149167 | 10/2013 |
| WO | WO-2013/169338 | 11/2013 |
| WO | WO-2013/184912 | 12/2013 |
| WO | WO-2014/089169 | 6/2014 |
| WO | WO-2014/198002 | 12/2014 |
| WO | WO-2014/207063 | 12/2014 |
| WO | WO-2015/009856 | 1/2015 |
| WO | WO-2015/107026 | 7/2015 |
| WO | 2015113494 A1 | 8/2015 |
| WO | WO-2015/120363 | 8/2015 |
| WO | 2015181343 A2 | 12/2015 |
| WO | 2016008976 A1 | 1/2016 |
| WO | WO-2016/011083 | 1/2016 |
| WO | WO-2016/011264 | 1/2016 |
| WO | WO-2016/191643 | 1/2016 |
| WO | 2016027995 A1 | 2/2016 |
| WO | WO-2016/022994 | 2/2016 |
| WO | WO-2016/034678 | 3/2016 |
| WO | WO-2016/073704 | 5/2016 |
| WO | WO-2016/118577 | 7/2016 |
| WO | 2016164428 A1 | 10/2016 |
| WO | 2016168771 A2 | 10/2016 |
| WO | WO-2016/154684 | 10/2016 |
| WO | WO-2016/168771 | 10/2016 |
| WO | 2017027817 A1 | 2/2017 |
| WO | WO-2017/019846 | 2/2017 |
| WO | WO-2017/023749 | 2/2017 |
| WO | WO-2017/023779 | 2/2017 |
| WO | WO-2017/029389 | 2/2017 |
| WO | WO-2017/048878 | 3/2017 |
| WO | 2017055547 A1 | 4/2017 |
| WO | 2017085307 A1 | 5/2017 |
| WO | WO-2017/079117 | 5/2017 |
| WO | WO-2017/106061 | 6/2017 |
| WO | 2017151818 A2 | 9/2017 |
| WO | WO-2017/181148 | 10/2017 |
| WO | WO-2017/181152 | 10/2017 |
| WO | 2017201210 A1 | 11/2017 |
| WO | WO-2017/201131 | 11/2017 |
| WO | WO-2018/022945 | 2/2018 |
| WO | WO-2018/022946 | 2/2018 |
| WO | WO-2018/075978 | 4/2018 |
| WO | WO-2018/170021 | 9/2018 |
| WO | WO-2018/170023 | 9/2018 |
| WO | WO-2018/170026 | 9/2018 |
| WO | 2019079520 A2 | 4/2019 |
| WO | WO-2019/136179 | 7/2019 |
| WO | 2019241758 A1 | 12/2019 |
| WO | 2020047329 A1 | 3/2020 |
| WO | 2020061376 A2 | 3/2020 |
| WO | 2021181233 A2 | 9/2021 |
| WO | 2023172883 A1 | 9/2023 |

OTHER PUBLICATIONS

"Database accession No. ADM18706." Retrieved from IBIS, http://ibis/exam/dbfetch.jsp?id=GSP:ADM18706. Retrieved on Oct. 10, 2017.

"Database accession No. ADM18913." Retrieved from IBIS, http://ibis/exam/dbfetch.jsp?id=GSP:ADM18913. Retrieved on Oct. 10, 2017.

"Database accession No. B3TFD9," version 63. Retrieved from Uniprot, http://www.uniprot.org/uniprot/B3TFD9.txt?version=63. Retrieved on Dec. 10, 2017.

"Database accession No. BCD07227." Retrieved from IBIS, http://ibis/exam/dbfetch.jsp?id=GSP:BCD07227. Retrieved on Oct. 10, 2017.

"Database accession No. BCD07228." Retrieved from IBIS, http://ibis/exam/dbfetch.jsp?id=GSP:BCD07228. Retrieved on Oct. 10, 2017.

"Database accession No. BD020821," Retrieved from Geneseq, https://www.ebi.ac.uk/ena/data/view/BD020821. Retrieved on May 16, 2018.

"Database accession No. BD020825," Retrieved from Geneseq, https://www.ebi.ac.uk/ena/data/view/BD020825. Retrieved on May 16, 2018.

"Database accession No. F1PWL4," version 43. Retrieved from Uniprot, http://www.uniprot.org/uniprot/F1PWL4.txt?version=43. Retrieved on Dec. 10, 2017.

"Database accession No. F7DZ76," version 32. Retrieved from Uniprot, http://www.uniprot.org/uniprot/F7DZ76. Retrieved on Jun. 6, 2018.

"Database accession No. G1SUI3," version 36. Retrieved from Uniprot, http://www.uniprot.org/uniprot/G1SUI3.txt. Retrieved on Jun. 6, 2018.

"Database accession No. P32506," version 99. Retrieved from Uniprot, http://www.uniprot.org/uniprot/P32506.txt. Retrieved on Jan. 18, 2018.

Baban et al., "Bacteria as vectors for gene therapy of cancer," Bioeng Bugs. (2010) 1(6):385-394.

Behr et al., "Trastuzumab and breast cancer," N Engl J Med.(2001) 345:995-996.

Benson et al., "GenBank," Nucleic Acids Res (2013) 41(Database issue):D36-D42.

Biasini et al., "Swiss-Model: modelling protein tertiary and quaternary structure using evolutionary information," Nucleic Acids Res (2014) 42:W252-258.

Boder et al., "Optimal screening of surface-displayed polypeptide libraries," Biotechnol Prog. (1998) 14:55-62.

Brandt et al., The B7 family member B7-H6 is a tumor cell ligand for the activating natural killer cell receptor NKp30 in humans. J Exp Med. (2009) 206:1495-1503.

Brown et al., "Structure-based mutagenesis of the human immunodeficiency virus type 1 DNA attachment site: effects on integration and cDNA synthesis," J Virol. (1999) 73(11):9011-9020.

Bruggemann et al., "Comparison of the effector functions of human immunoglobulins using a matched set of chimeric antibodies," J Exp Med. (1987) 166(5):1351-1361.

Buchschacher et al., "Human immunodeficiency virus vectors for inducible expression of foreign genes," J Virol. (1992) 66(5):2731-2739.

Burmeister et al., ICOS controls the pool size of effector-memory and regulatory T cells. J Immunol.(2008) 180:774-82.

Carter et al., "Cytotoxic T-lymphocyte antigen-4 and programmed death-1 function as negative regulators of lymphocyte activation," Immunol Res (2003) 28:49-59.

Carter et al., "Humanization of an anti-p185HER2 antibody for human cancer therapy," Proc Natl Acad Sci USA (1992) 89:4285-4289.

Chakrabarti et al., "A mutant B7-1/lg fusion protein that selectively binds to CTLA-4 ameliorates anti-tumor DNA vaccination and counters regulatory T cell activity", Vaccine, Elsevier, Amsterdam, NL, vol. 23, No. 37, Aug. 31, 2005 pp. 4553-4564.

(56) References Cited

OTHER PUBLICATIONS

Chang et al., "The discovery of small molecule carbamates as potent dual alpha(4)beta(1)/alpha(4)beta(7) integrin antagonists," Bioorg Med Chem Lett. Jan. 21, 2002;12(2):159-63.

Chao et al., "Isolating and engineering human antibodies using yeast surface display," Nat Protoc. (2006) 1:755-768.

Chari et al., "Immunoconjugates containing novel maytansinoids: promising anticancer drugs," Cancer Res. (1992) 52(1):127-131.

Chattopadhyay et al., "Structural basis of inducible costimulator ligand costimulatory function: determination of the cell surface oligomeric state and functional mapping of the receptor binding site of the protein," J Immunol. Sep. 15, 2006;177(6):3920-9.

Clynes et al., "Fc receptors are required in passive and active immunity to melanoma," Proc Natl Acad Sci U S A. (1998) 95(2):652-656.

Colby et al., "Engineering antibody affinity by yeast surface display," Methods Enzymol. 2004;388:348-58.

Colcher et al., "Use of monoclonal antibodies as radiopharmaceuticals for the localization of human carcinoma xenografts in athymic mice," Methods Enzymol. (1986); 121: 802-16.

Condomines et al., "Tumor-Targeted Human T Cells Expressing CD28-Based Chimeric Antigen Receptors Circumvent CTLA-4 Inhibition," PLoS One (2015) 10(6):e0130518.

Cornetta et al., "No retroviremia or pathology in long-term follow-up of monkeys exposed to a murine amphotropic retrovirus," Hum Gene Ther. (1991) Fall;2(3):215-9.

Cragg et al., "Antibody specificity controls in vivo effector mechanisms of anti-CD20 reagents," Blood. (2004) 103(7):2738-2743.

Cragg et al., "Complement-mediated lysis by anti-CD20 mAb correlates with segregation into lipid rafts," Blood. (2003) 101(3):1045-1052.

David et al., "Protein iodination with solid state lactoperoxidase," Biochemistry. Feb. 26, 1974;13(5):1014-21.

Deisenhofer et al., "Crystallographic refinement and atomic models of a human Fc fragment and its complex with fragment B of protein A from *Staphylococcus aureus* at 2.9- and 2.8-A resolution," Biochemistry. Apr. 28, 1981;20(9):2361-70.

Derer et al., Complement in antibody-based tumor therapy. Crit Rev Immunol. (2014) 34:199-214.

Doty et al., "Two regions in the CD80 cytoplasmic tail regulate CD80 redistribution and T cell costimulation," J Immunol. (1998) 161(6): 2700-2707.

Dull et al., "A Third-Generation Lentivirus Vector with a Conditional Packaging System," J Virology (1998) 72(11): 8463-8471.

Duncan et al., "The binding site for C1q on IgG," Nature. Apr. 21, 1988;332(6166):738-40.

Ellis et al., "Interactions of CD80 and CD86 with CD28 and CTLA4,"J Immunol (1996) 156:2700-2709.

Engelman et al., "Multiple effects of mutations in human immunodeficiency virus type 1 integrase on viral replication," J Virol. 1995 69(5):2729-2736.

Esensten et al., CD28 costimulation: from mechanism to therapy. Immunity. (2016) 44:973-988.

Evans et al., "Novel immunomodulatory proteins generated via directed evolution of variant IgSF domains," Abstract for AAI Immunology 2017, Washington D.C. (May 12-16, 2017) 1 page Published April A852017.

Evans et al., "Novel immunomodulatory proteins generated via directed evolution of variant IgSF domains," Poster for AAI Immunology 2017, Washington D.C. (May 12-16, 2017) 1 page.

Evans et al., "Therapeutic T Cell Activation Using Engineered Variant IgSF Domains," Abstract for Society for Immunotherapy of Cancer, National Harbor, MD, (Nov. 9-13, 2016) 1 page Published Nov. 8, 2016.

Evans et al., "Therapeutic T Cell Activation Using Engineered Variant IgSF Domains," Poster presented at Society for Immunotherapy of Cancer, National Harbor, MD, (Nov. 9-13, 2016) 1 page.

Fraker et al., "Protein and cell membrane iodinations with a sparingly soluble chloroamide, 1,3,4,6-tetrachloro-3a,6a-diphrenylglycoluril," Biochem Biophys Res Commun. Feb. 28, 1978;80(4):849-57.

Freeman et al., "Engagement of the PD-1 immunoinhibitory receptor by a novel B7 family member leads to negative regulation of lymphocyte activation," J Exp Med (2000) 192(7):1027-1034.

Garcia-Aragoncillo et al., "Design of virotherapy for effective tumor treatment," Curr Opin Mol Ther. Aug. 2010;12(4):403-11.

Gazzano-Santoro et al., "A non-radioactive complement-dependent cytotoxicity assay for anti-CD20 monoclonal antibody," J Immunol Methods. Mar. 28, 1997;202(2):163-71.

Gherardi et al., "Recombinant poxviruses as mucosal vaccine vectors," J Gen Virol. (2005) 86(Pt 11):2925-2936.

Ghiotto, M., et al."PD-L 1 and PD-L2 differ in their molecular mechanisms of interaction with PD-1", International Immunology, 2010, vol. 22, No. 8, pp. 651-660.

Gregoire-Gauthier et al., "Use of immunoglobulins in the prevention of GvHD in a xenogeneic NOD/SCID/gammac-mouse model," Bone Marrow Transplant (2012) 47:439-450.

Guerra et al., "Host response to the attenuated poxvirus vector NYVAC: upregulation of apoptotic genes and NF-kappaB-responsive genes in infected Hela cells," J Virol. (2006) 80(2): 985-98.

Haile et al., "Tumor Cell Programmed Death Ligand 1-Mediated T Cell Suppression ins overcome by coexpression of CD80," J Immunol (2011) 186(12):6822-6829.

Haile et al., "Soluble CD80 restores T cell activation and overcomes tumor cell programmed death ligand 1-mediated immune suppression," J Immunol. (2013) 191(5):2829-36.

Halaby et al., "The immunoglobulin superfamily: an insight on its tissular, species, and functional diversity," J Mol Evol (1998) 46:389-400.

Hallden et al., "Oncolytic virotherapy with modified adenoviruses and novel therapeutic targets," Expert Opin Ther Targets. Oct. 2012;16(10):945-58.

Harris et al., "CD80 costimulation is essential for the induction of airway eosinophilia," J Exp Med. Jan. 6, 1997;185(1):177-82.

Hellstrom et al., "Antitumor effects of L6, an IgG2a antibody that reacts with most human carcinomas," Proc Natl Acad Sci U S A. (1986) 83(18):7059-7063.

Hellstrom et al., "Strong antitumor activities of IgG3 antibodies to a human melanoma-associated ganglioside," Proc Natl Acad Sci U S A. (1985) 82(5):1499-1502.

Hezareh et al., "Effector function activities of a panel of mutants of a broadly neutralizing antibody against human immunodeficiency virus type 1," J Virol (2001) 75(24):12161-12168.

Hinman et al., "Preparation and characterization of monoclonal antibody conjugates of the calicheamicins: a novel and potent family of antitumor antibiotics," Cancer Res. (1993) 53(14):3336-3342.

Hu et al., "Yaba-like disease virus: an alternative replicating poxvirus vector for cancer gene therapy," J Virol. (2001) 75(21):10300-10308.

Hunter et al., "Preparation of iodine-131 labelled human growth hormone of high specific activity," Nature. May 5, 1962;194:495-6.

Idusogie et al., "Mapping of the C1q binding site on rituxan, a chimeric antibody with a human IgG1 Fc," J Immunol. (2000) 164(8):4178-4184.

IMGT Scientific Chart, "Correspondence between the IMGT unique numbering for C-Domain, the IMGT exon numbering, the Eu and Kabat numberings: Human IGHG," Last updated Aug. 6, 2016. Retrieved from http://www.imgt.org/IMGTScientificChart/Numbering/Hu_IGHGnber.html.

Infante et al., "Overview Clinical and Pharmacodynamic (PD) Results of a Phase 1 Trial with AMP-224 (B7-DC Fc) that Binds to the PD-1 Receptor," Journal of Clinical Oncology (2013) 31(15_suppl):3044-3044.

Jenkins et al., "CD28 delivers a costimulatory signal involved in antigen-specific IL-2 production by human T cells," J Immunol. (1991) 147:2461-6.

(56)            References Cited

OTHER PUBLICATIONS

Johann et al., "GLVR1, a receptor for gibbon ape leukemia virus, is homologous to a phosphate permease of Neurospora crassa and is expressed at high levels in the brain and thymus," J Virol. (1992) 66(3):1635-1640.

Jones, "Critically assessing the state-of-the-art in protein structure prediction," Pharmacogenomics J. (2001); 1(2): 126-34.

Ke et al., "Rapid and efficient site-directed mutagenesis by single-tube 'megaprimer' PCR method," Nucleic Acids Research (1997) 25(16):3371-3372.

Khalil et al., "The future of cancer treatment: immunomodulation, CARs and combination immunotherapy," Nat Rev Clin Oncol. (2016) 13(5):273-90.

Khan et al., "Characterization of the New World monkey homologues of human poliovirus receptor CD155," J Virol. Jul. 2008;82(14):7167-79.

Kirn et al., "Targeted and armed oncolytic poxviruses: a novel multi-mechanistic therapeutic class for cancer," Nat Rev Cancer. Jan. 2009;9(1):64-71.

Koike et al., "A second gene for the African green monkey poliovirus receptor that has no putative N-glycosylation site in the functional N-terminal immunoglobulin-like domain," J Virol. Dec. 1992;66(12):7059-66.

Kojima et al., "Fusion Protein of Mutant B7-DC and Fc Enhances the Antitumor Immune Effect of GM-CSF-secreting Whole-cell Vaccine," J Immunother. (2014) 37(3):147-54.

Kolberg, "Gene-transfer virus contaminant linked to monkey's cancer," J NIH Res. (1992) 4:43-44.

Kremer et al., "Treatment of rheumatoid arthritis by selective inhibition of T-cell activation with fusion protein CTLA4Ig," N Engl J Med (2003) 349(20):1907-1915.

Labrijn et al., "Therapeutic IgG4 antibodies engage in Fab-arm exchange with endogenous human IgG4 in vivo," Nat Biotechnol. Aug. 2009;27(8):767-71.

Larsen et al., "Rational development of LEA29Y (belatacept), a high-affinity variant of CTLA4-Ig with potent immunosuppressive properties," Am J Transplant. Mar. 2005;5(3):443-53.

Leabman et al., "Effects of altered FcγR binding on antibody pharmacokinetics in cynomolgus monkeys," MAbs. (2013) 5(6):896-903.

Li et al., "Comparison of anti-CD3 and anti-CD28-coated beads with soluble anti-CD3 for expanding human T cells: differing impact on CD8 T cell phenotype and responsiveness to restimulation," J Transl Med. (2010) 8:104.

Li et al., "Structure of the human activating natural cytotoxicity receptor NKp30 bound to its tumor cell ligand B7-H6," J Exp Med (2011) 208(4): 703-714.

Lin et al., "Specific and dual antagonists of alpha(4)beta(1) and alpha(4)beta(7) integrins," Bioorg Med Chem Lett. Jan. 21, 2002;12(2):133-6.

Lindblad-Toh et al., "A high-resolution map of human evolutionary constraint using 29 mammals," Nature (2011) 478(7370):476-482.

Lindblad-Toh et al., "Genome sequence, comparative analysis and haplotype structure of the domestic dog," Nature. Dec. 8, 2005;438(7069):803-19.

Linderholm et al., "Immunoglobulin Fc-Fusion Proteins," Bio Process International. (2014) 12(10): 20-27.

Linsley et al., "Human B7-1 (CD80) and B7-2 (CD86) bind with similar avidities but distinct kinetics to CD28 and CTLA-4 receptors," Immunity. (1994) 1(9): 793-801.

Lipson et al., "Antagonists of PD-1 and PD-L1 in Cancer Treatment," *Semin Oncol*. Aug. 2015;42(4):587-600.

Liu et al., "Crystal structure of cell adhesion molecule nectin-2/CD112 and its binding to immune receptor DNAM-1/CD226," J Immunol. Jun. 1, 2012;188(11):5511-20.

Liu et al., "Eradication of large colon tumor xenografts by targeted delivery of maytansinoids," Proc Natl Acad Sci U S A. (1996) 93(16):8618-8623.

Lobner et al., "Engineered IgG1-Fc—one fragment to bind them all," Immunol Rev (2016) 270(1):113-31.

Lode et al., "Targeted therapy with a novel enediyene antibiotic calicheamicin theta(I)1 effectively suppresses growth and dissemination of liver metastases in a syngeneic model of murine neuroblastoma," Cancer Res. (1998) 58(14):2925-2928.

Mandler et al., "Modifications in synthesis strategy improve the yield and efficacy of geldanamycin-herceptin immunoconjugates," Bioconjug Chem. Jul.-Aug. 2002;13(4):786-91.

Maurer et al., "ALPN-202 combines checkpoint inhibition with conditional T cell costimulation to overcome T cell suppression by M2c macrophages and improve the durability of engineered T cell anti-tumor responses," AACR Annual Meeting 2020; Cancer Res (2020) 80(16suppl):Abstract nr LB-085.

Mayr et al., "Passage history, properties, and applicability of the attenuated vaccinia virus strain MVA," Infection. (1975);3:6-14. (English translation of abstract provided).

McLoughlin et al., "TNFerade, an adenovector carrying the transgene for human tumor necrosis factor alpha, for patients with advanced solid tumors: surgical experience and long-term follow-up," Ann Surg Oncol. Oct. 2005;12(10):825-30.

McWilliams et al., "Mutations in the 5' end of the human immunodeficiency virus type 1 polypurine tract affect RNase H cleavage specificity and virus titer," J Virol. (2003) 77(20):11150-11157.

Mease et al., "Efficacy and safety of abatacept, a T-cell modulator, in a randomised, double-blind, placebo-controlled, phase III study in psoriatic arthritis," Ann Rheum Dis. (2017) 76:1550-8.

Merchant et al., "An efficient route to human bispecific IgG," Nat Biotechnol. (1998) 16(7): 677-681.

Mercier et al., "A chimeric adenovirus vector encoding reovirus attachment protein sigma1 targets cells expressing junctional adhesion molecule 1," Proc Natl Acad Sci U S A. (2004) 101(16): 6188-6193.

Metzler et al., "Solution structure of human CTLA-4 and delineation of a CD80/CD86 binding site conserved in CD28," Nat Struct Biol (1997) 4(7):527-31.

Miller et al., "Construction and properties of retrovirus packaging cells based on gibbon ape leukemia virus," J Virol. (1991) 65(5):2220-2224.

Miller et al., "Construction and screening of antigen targeted immune yeast surface display antibody libraries," Curr Protoc Cytom. Jul. 2008; Chapter 4: Unit4.7, 30 pages.

Miller et al., "Gene transfer by retrovirus vectors occurs only in cells that are actively replicating at the time of infection," Mol Cell Biol. (1990) 10(8):4239-4242.

Miller, "Protein-protein recognition and the association of immunoglobulin constant domains," J Mol Biol. Dec. 20, 1990;216(4):965-73.

Milone et al., "Chimeric receptors containing CD137 signal transduction domains mediate enhanced survival of T cells and increased antileukemic efficacy in vivo," Mol Ther. (2009) 17(8):1453-64.

Miyoshi et al. "Development of a self-inactivating lentivirus vector," J Virol. (1998) 72(10):8150-8157.

Molin et al., "Two novel adenovirus vector systems permitting regulated protein expression in gene transfer experiments," J Virol. (1998) 72(10):8358-8361.

Morton et al., "Differential effects of CTLA-4 substitutions on the binding of human CD80 (B7-1) and CD86 (B7-2)," J Immunol. (1996) 156(3):1047-1054.

Narumi et al., "Adenovirus vector-mediated perforin expression driven by a glucocorticoid-inducible promoter inhibits tumor growth in vivo," Am J Respir Cell Mol Biol. (1998) 19(6):936-941.

Nightingale et al., "Transient gene expression by nonintegrating lentiviral vectors," Mol Ther. (2006) 13(6):1121-1132.

Nygren, "Conjugation of horseradish peroxidase to Fab fragments with different homobifunctional and heterobifunctional cross-linking reagents. A comparative study," J Histochem Cytochem. May 1982;30(5):407-12.

Ochoa et al., "Antibody-dependent cell cytotoxicity: immunotherapy strategies enhancing effector NK cells," Immunol Cell Biol. (2017) 95:347-55.

Pain et al., "Preparation of protein A-peroxidase monoconjugate using a heterobifunctional reagent, and its use in enzyme immunoassays," J Immunol Methods. (1981);40(2):219-30.

(56) References Cited

OTHER PUBLICATIONS

Parslow et al., "Antibody-drug conjugates for cancer therapy," Biomedicines. (2016) 4:E32.

Patyar et al., "Bacteria in cancer therapy: a novel experimental strategy," J Biomed Sci. (2010) 17(1):21.

Peach et al., "Both extracellular immunoglobin-like domains of CD80 contain residues critical for binding T cell surface receptors CTLA-4 and CD28," J Biol Chem. (1995) 270(36):21181-7.

Penix et al., "Two essential regulatory elements in the human interferon gamma promoter confer activation specific expression in T cells," J Exp Med. (1993) 178(5):1483-1496.

Peper et al., "An impedance-based cytotoxicity assay for real-time and label-free assessment of T-cell-mediated killing of adherent cells," J Immunol Methods. Mar. 2014;405:192-8.

Pérez De La Lastra et al., "Epitope mapping of 10 monoclonal antibodies against the pig analogue of human membrane cofactor protein (MCP)," Immunology. (1999) 96(4):663-70.

Petkova et al., "Enhanced half-life of genetically engineered human IgG1 antibodies in a humanized FcRn mouse model: potential application in humorally mediated autoimmune disease," Int Immunol. (2006) 18(12):1759-1769.

Pfeifer et al., "Gene therapy: promises and problems," Annu Rev Genomics Hum Genet. (2001); 2:177-211.

Philpott et al., "Use of nonintegrating lentiviral vectors for gene therapy," Hum Gene Ther. (2007) 18(6): 483-9.

Powell et al., "Sequence and structural determinants required for priming of plus-strand DNA synthesis by the human immunodeficiency virus type 1 polypurine tract," J Virol. (1996) 70(8):5288-5296.

Ravetch et al., "Fc receptors," Annu Rev Immunol. (1991) 9:457-492.

Rennert et al., "The IgV domain of human B7-2 (CD86) is sufficient to co-stimulate T lymphocytes and induce cytokine secretion," International Immunology (1997) 9(6):805-813.

Ridgway et al., "'Knobs-into-holes' engineering of antibody CH3 domains for heavy chain heterodimerization," Protein Eng. Jul. 1996;9(7):617-21.

Rowland et al., "Drug localisation and growth inhibition studies of vindesine-monoclonal anti-CEA conjugates in a human tumour xenograft," Cancer Immunol Immunother. (1986);21(3):183-7.

Ruperto et al., "Abatacept in children with juvenile idiopathic arthritis: a randomised, double-blind, placebo-controlled withdrawal trial. Lancet. (2008) 372:383-391.

Sadelain, M. et al., "The basic principles of chimeric antigen receptor design." Cancer Discov., Apr. 2013, vol. 3, No. 4, pp. 388-398.

Sarmay, Gabriella, et al. "Mapping and comparison of the interaction sites on the Fc region of IgG responsible for triggering antibody dependent cellular cytotoxicity (ADCC) through different types of human Fcγ receptor." Molecular immunology 29.5 (1992): 633-639.

Schildberg et al., "Coinhibitory Pathways in the B7-CD28 Ligand-Receptor Family," Immunity. (2016) 44(5): 955-72.

Scholten et al., "Promiscuous behavior of HPV16E6 specific T cell receptor beta chains hampers functional expression in TCR transgenic T cells, which can be restored in part by genetic modification," Cell Oncol. (2010) 32:43-56.

Seow et al., "Biological gene delivery vehicles: beyond viral vectors," Mol Ther. (2009) 17(5):767-777.

Shields et al., "High resolution mapping of the binding site on human IgG1 for Fc gamma RI, Fc gamma RII, Fc gamma RIII, and FcRn and design of IgG1 variants with improved binding to the Fc gamma R," J Biol Chem. (2001) 276(9):6591-6604.

Sommerfelt et al., "Receptor interference groups of 20 retroviruses plating on human cells," Virology. (1990) 176(1): 58-69.

Srinivasan et al., "Immunomodulatory peptides from IgSF proteins: a review," Curr Protein Pept Sci. (2005) 6(2):185-96.

Srivastava et al., "Engineering CAR-T cells: Design Concepts," Trends in Immunology (2015) 36(8):494-502.

Tangney et al., "The use of Listeria monocytogenes as a DNA delivery vector for cancer gene therapy," Bioeng Bugs. (2010) 1(4):284-287.

Tareen et al., "Design of a novel integration-deficient lentivector technology that incorporates genetic and posttranslational elements to target human dendritic cells," Mol Ther. (2014) 22(3):575-587.

Tartaglia et al., "Highly attenuated poxvirus vectors," AIDS Res Hum Retroviruses. (1992) 8(8):1445-1447.

Terawaki et al., "Specific and high-affinity binding of tetramerized PD-L1 extracellular domain to PD-1-expressing cells: possible application to enhance T cell function," Int Immunol (2007) 19(7):881-890.

Topalian et al., "Safety, activity, and immune correlates of anti-PD-1 antibody in cancer," N engl J Med (2012) 366:2443-2454.

Tosatto et al., "Large-scale prediction of protein structure and function from sequence," Curr Pharm Des. (2006); 12(17): 2067-86.

Trentin F et al., "Effectiveness, Tolerability, and Safety of Belimumab in Patients with Refractory SLE: a Review of Observational Clinical-Practice-Based Studies" Clinical Reviews in Allergy & Immunology (2018) 54:331-343.

Vafa et al., "An engineered Fc variant of an IgG eliminates all immune effector functions via structural perturbations," Methods. (2014) 65(1):114-26.

Van Der Merwe et al., "CD80 (B7-1) binds both CD28 and CTLA-4 with a low affinity and very fast kinetics," J exp Med (1997) 185:393-403.

Van Pijkeren et al., "A novel Listeria monocytogenes-based DNA delivery system for cancer gene therapy," Hum Gene Ther. Apr. 2010;21(4):405-16.

Vincenti et al., "Costimulation blockade with belatacept in renal transplantation," N Engl J Med. (2005) 353:770-81.

Vitetta et al., "Redesigning nature's poisons to create anti-tumor reagents," Science. Nov. 20, 1987;238(4830): 1098-104.

Wade et al., "Genome sequence, comparative analysis, and population genetics of the domestic horse," Science. Nov. 6, 2009;326(5954):865-867.

Wang et al., "In vitro characterization of the anti-PD-1 antibody nivolumab, BMS-936558, and in vivo toxicology in non-human primates," Cancer Immunol Res. (2014) 2(9):846-856.

Wang et al., "Molecular cloning, characterization and three-dimensional modeling of porcine nectin-2/CD112," Vet Immunol Immunopathol. 2009 132(2-4):257-63.

Wang et al., "Molecular modeling and functional mapping of B7-H1 and B7-DC uncouple costimulatory function from PD-1 interaction," J Exp Med. 2003 197(9):1083-91.

Weber et al., "ICOS maintains the T follicular helper cell phenotype by down-regulating Kruppel-like factor 2," J Exp Med. (2015) 212:217-33.

Wekerle et al., "Belatacept: from rational design to clinical application," Transplant International (2012) 25:139-150.

Wilson et al., "Formation of infectious hybrid virions with gibbon ape leukemia virus and human T-cell leukemia virus retroviral envelope glycoproteins and the gag and pol proteins of Moloney murine leukemia virus," J Virol. (1989) 63(5):2374-2378.

Wolchok et al., Development of ipilimumab: a novel immunotherapeutic approach for the treatment of advanced melanoma. Ann N Y Acad Sci. (2013) 1291:1-13.

Wu et al., "CTLA-4-B7 Interaction Is Sufficient to Costimulate T Cell Clonal Expansion," J. Exp. Med. (1997) 185(7):1327-1335.

Wu et al., "IL-24 modulates IFN-gamma expression in patients with tuberculosis," Immunol Lett. (2008) 117(1):57-62.

Yao et al., "B7-h2 is a costimulatory ligand for CD28 in human," Immunity. (2011) 34(5):729-40.

Yoshinaga et al., cell co-stimulation through B7RP-1 and ICOS. Nature. (1999) 402:827-832.

Yu et al., "The role of B7-CD28 co-stimulation in tumor rejection," Int Imm (1998) 10(6):791-797.

Zhang et al., "An NKp30-Based Chimeric Anitgen Receptor Promotes T Cell Effector Functions and Antitumor Efficacy In Vivo," J Immunol (2012) 189:2290-2299.

Zhao et al., "A Bispecific Protein Capable of Engaging CTLA-4 and MHCII Protects Non-Obese Diabetic Mice from Autoimmune Diabetes," PLoS One (2013) 8(5):e63530-e63530.

(56)     References Cited

OTHER PUBLICATIONS

Zhao et al., "Structural Design of Engineered Costimulation Determines Tumor Rejection Kinetics and Persistence of CAR T Cells," Cancer Cell (2015) 28(4):415-428.

Zhao et al., "TIGIT overexpression diminishes the function of CD4 T cells and ameliorates the severity of rheumatoid arthritis in mouse models," Exp Cell Res. Jan. 1, 2016;340(1):132-8.

Zufferey et al., "Self-inactivating lentivirus vector for safe and efficient in vivo gene delivery," J Virol. (1998) 72(12):9873-9880.

Murshudov et al., "REFMAC5 for the refinement of macromolecular crystal structures," Acta Crystallogr D Biol Crystallogr, 2011. 67(Pt 4): p. 355-67.

NCBI Conserved Domain Search, Jun. 30, 2021 (Year: 2021).

Newton et al., "Angiogenin Single-Chain Immunofusions: Influence of Peptide Linkers and Spacers between Fusion Protein Domains," Biochemistry (1996) 35(2):545-553.

Nishimori et al., "Identification and characterization of bovine programmed deathligand 2," Microbiol Immunol. (2014) 58(7):388-97.

Oshima et al., "ASP2408 and ASP2409, novel CTLA4-Ig variants with CD86-selective ligand binding activity and improved immunosuppressive potency, created by directed evolution," Protein Engineering, Design and Selection (2016) 29(5):159-167.

Ott et al., "Combination immunotherapy: a road map," J Immunother Cancer (2017) 5:16.

Paczesny et al., "A biomarker panel for acute graft-versus-host disease," Blood. (2009) 113(2): 273-278.

Paczesny et al., "Elafin is a biomarker of graft-versus-host disease of the skin," Sci Trans Med., Jan. 2010, 2 (13): 13ra2, 19 pages.

Paczesny, "Biomarkers for posttransplantation outcomes," Blood. (2018) 131(20): 2193-2204.

Patton et al., "Evaluation of the efficiency of human immune system reconstitution in NSG mice and NSG mice containing a human HLA.A2 transgene using hematopoietic stem cells purified from different sources", J Immunol Methods. (2015) 422: 13-21.

Paulos et al., "The inducible costimulator (ICOS) is critical for the development of human T(H)17 cells," Sci Transl Med., Oct. 2010, 2(55): 55ra78, 27 pages.

Peach et al., "Complementarity determining region 1 (CDR1)- and CDR3-analogous regions in CTLA-4 and CD28 determine the binding to B7-1," J Exp Med (1994) 180(6):2049-2058.

Protein Data Bank, "118L, Human B7-1/CTLA-4 Co-Stimulatory Complex," Released on Apr. 4, 2001. Retrieved from https://www.rcsb.org/structure/118L.

Protein Data Bank, "3UDW, Crystal structure of the immunoreceptor TIGIT in complex with Poliovirus receptor (PVR/CD155/necl-5) D1 domain," Retrieved from http://www.rcsb.org/structure/3UDW . Retrieved on Jun. 5, 2018.

Qin et al., "Incorporation of a hinge domain improves the expansion of chimeric antigen receptor T cells," J Hematol Oncol. (2017) 10(1):68.

Ramadan et al., "From proteomics to discovery of first-in-class ST2 inhibitors active in vivo," JCI Insight. (2018) 3(14): e99208, 17 pages.

Ramos M.I., et al., "FMS-Related Tyrosine Kinase 3 Ligand (Flt3L)/CD135 Axis in Rheumatoid Arthritis," Arthritis Research and Therapy, 2013, vol. 15, No. R209, 13 pages.

Reizis et al., "Plasmacytoid Dendritic Cells: Development, Regulation, and Function," Immunity. (2019) 50(1): 37-50.

Ren et al., "The search for drug-targetable diagnostic, prognostic and predictive biomarkers in chronic graft-versus-host disease," Expert Rev Clin Immunol. (2018) 14(5): 389-404.

Rentero et al., "Screening of Large Molecule Diversities by Phage Display," Chimia (Aarau) (2011) 65(11): 843-845.

Reynoso et al., "Intestinal Tolerance Is Converted to Autoimmune Ligand Blockade," J Immunol (2009) 182(4):2102-2112.

Ribas et al., Cancer immunotherapy using checkpoint blockade. Science (2018) 359:1350-1355.

Roach et al., "Development of a Companion Diagnostic PD-L1 Immunohistochemistry Assay for Pembrolizumab Therapy in Non-Small-cell Lung Cancer," Appl Immunohistochem Mol Morphol (2016) 24(6): 392-7.

Rosenberg et al., "Use of tumor-infiltrating lymphocytes and interleukin-2 in the immunotherapy of patients with metastatic melanoma. A preliminary report," N Engl J Med. (1988) 319(25):1676-1680.

Rowshanravan et al., "CTLA-4: a moving target in immunotherapy," Blood (2018) 131(1):58-67.

Rozali et al., "Programmed death ligand 2 in cancer-induced immune suppression," Clin Dev Immunol (2012) 2012:656340, 9 pages.

Scarpa et al., "CD80 down-regulation is associated to aberrant DNA methylation in non-inflammatory colon carcinogenesis," BMC Cancer (2016):388.

Scatchard et al., "The attractions of proteins for small molecules and ions," Ann. N.Y. Acad. Sci. (1949) 51:660-672.

Schwartz et al., "Structural Basis for Co-Stimulation by the Human CTLA-4/B7-2 Complex," Nature (2001) 410 (6828), 604-608.

Schwartz et al., "Structural mechanisms of costimulation," Nat Immunol (2002) 3(5):427-434.

Sciascia S. et al., "Recent advances in the management of systemic lupus erythematosus" [version 1; referees approved:2] F1000Research 2018, 7(F1000 Faculty Rev): 970 Last updated: Jun. 29, 2018.

Shenoi et al., "Comparison of Biomarkers for Systemic Juvenile Idiopathic Arthritis," Pediatric Research, Aug. 12, 2015, vol. 78(5), pp. 554-559.

Sim et al., "Altered expression of costimulatory molecules in Behcet's disease according to clinical activity," Br J Dermatol (2011) 164(6):1285-1291.

Song et al., "Protective effects of Fe-fused PD-LI on two different animal models of colitis," Gut (2015) 64:260-271.

Stamper et al., "Crystal structure of the B7-1/CTLA-4 complex that inhibits human immune responses," Nature. (2001) 410(6828):608-611.

Staub et al., "Systematic identification of immunoreceptor tyrosine-based inhibitory motifs in the human proteome," Cell Signal (2004) 16(4):435-456.

Stebbings et al., "After TGN1412: recent developments in cytokine release assays," J Immunotoxicol (2013) 10(1):75-82.

Strohl, "Optimization of Fc-mediated effector functions of monoclonal antibodies," Curr Opin Biotechnol. Dec. 2009;20(6):685-91.

Sturmhoefel et al., "Potent Activity of Soluble B7-IgG Fusion Proteins in Therapy of Established Tumors and as Vaccine Adjuvant," Cancer Res. (1999) 59(19): 4964-4972.

Sul et al., "FDA Approval Summary: Pembrolizumab for the Treatment of Patients With Metastatic Non-Small Cell Lung Cancer Whose Tumors Express Programmed Death-Ligand 1," Oncologist (2016) 21(5):643-50.

Sutharalingam et al., "Cytokine storm in a phase 1 trial of the anti-CD28 monoclonal antibody TGN1412," N Engl J Med (2006) 355(10):1018-1028.

Swanson et al., "CD80 vIgD-Fc proteins combine checkpoint antagonism and costimulatory signaling for elicit potent anti-tumor immunity in vitro and in vivo," American Association for Cancer Research (AACR). Chicago, IL, Apr. 14-18, 2018, Abstract 4550, 1 page, published Jul. 2018.

Swanson et al., "ALPN-202, a combined PD-L1/CTLA-4 antagonist and PD-L1-dependent CD28 T cell costimulator, elicits potent intratumoral T cell immunity superior to and differentiated from PD-L1 inhibitor monotherapy" Abstract SITC 2018.

Taylor et al., "Targeting of inducible costimulator (ICOS) expressed on alloreactive T cells down-regulates graft-versus-host disease (GVHD) and facilitates engraftment of allogeneic bone marrow (BM)", Blood. (2005) 105(8): 3372-3380.

Teshima et al., "Response: Recipient plasmacytoid dendritic cells and graft-versus-host disease", Blood, the Journal of the American Society of Hematology, Aug. 2009, 114(6), p. 1280.

Thompson et al., "cis-acting sequences required for inducible interleukin-2 enhancer function bind a novel Ets-related protein, Elf-1," Mol Cell Biol. (1992) 12(3):1043-1053.

(56)            References Cited

OTHER PUBLICATIONS

Tirapu et al., "Low surface expression of B7-1 (CD80) is an immunoescape mechanism of colon carcinoma," Cancer Res. (2006) 66(4):2442-50.

Todd et al., "Transcription of the interleukin 4 gene is regulated by multiple promoter elements," J Exp Med. (1993) 177(6):1663-1674.

U.S. Appl. No. 15/567,068, filed Oct. 16, 2017, by Swanson et al. (Copy not provided).

U.S. Appl. No. 16/493,750, filed Sep. 12, 2019, Swanson, et al. (Copy not provided).

Huston J.S., et al., "Protein Engineering of Antibody Binding Sites: Recovery of Specific Activity in an Anti-Digoxin Single-Chain Fv Analogue Produced in *Escherichiacoli*," Proceedings of the National Academy of Sciences of the United States of America, Aug. 1988, vol. 85, pp. 5879-5883.

Ikemizu et al., "Structure and Dimerization of a Soluble Form of B7-1," Immunity (2000) 12:51-60.

Im et al., "Defining CD8+ T cells that provide the proliferative burst after PD-1 therapy," Nature (2016) 537 (7620):417-421.

International Search Report for Application No. PCT/US2018/022265, mailed Aug. 8, 2018, 9 pages.

Intlekofer et al., "At the bench: preclinical rationale for CTLA-4 and PD-1 blockade as cancer immunotherapy," J Leukoc biol (2013) 94(1):25-39.

Jenkins et al., "Mechanisms of resistance to immune checkpoint inhibitors," Br J. Cancer (2018) 118(1):9-16.

Jiang et al., "Signatures of T cell dysfunction and exclusion predict cancer immunotherapy response," Nat Med (2018) 24(10):1550-1558.

Jones et al., "Peripherally Induced Regulatory T Cells: Recruited Protectors of the Central Nervous System against Autoimmune Neuroinflammation," Front Immunol (2017) 8:532.

Juneja et al., "PD-L1 on tumor cell is sufficient for immune evasion in immunogenic tumors and inhibits CD8 T cell cytotoxicity." J Exp Med. (2017) 214(4):895-904.

Kabat et al., "Sequences of Proteins of Immunological Interest," Fifth Edition, U.S. Department of Health and Human Services, NIH Publication No. 91-3242 (1991), 83 pages.

Kabsch et al., "XDS" Acta Crystallogr D Biol Crystallogr, 2010. 66(Pt 2): p. 125-32.

Kamphorst et al., "Rescue of exhausted CD8 T cells by PD-1-targeted therapies is CD28-dependent," Science (2017) 355(6332):1423-1427.

Kawalec P, et al., "Comparative effectiveness of abatacept, apremilast, secukinumab and ustekinumab treatment of psoriatic arthritis: a systematic review and network metaanalysis" Rheumatology International (2018) 38:189-201.

Kim et al., "Programmed cell death ligand 1 alleviates psoriatic inflammation by suppressing IL-17A production from programmed cell death 1-high T cells," J Allergy Clin Immunol (2016) 137(5):1466-1476.

Koura et al., "In vivo T cell costimulation blockade with abatacept for acute graft-versus-host disease prevention: a first-in-disease trial," Biol Blood Marrow Transplant, (2013); 19(11): 1638-1649.

Koyama et al., "Plasmacytoid dendritic cells prime alloreactive T cells to mediate graft-versus-host disease as antigen-presenting cells," Blood. (2009) 113(9): 2088-2095.

Lander, International Human Genome Sequencing Consortium, "Initial sequencing and analysis of the human genome," Nature (2001) 409:860-921.

Laouar et al., "STAT3 is required for Flt3L-dependent dendritic cell differentiation," Immunity. (2003) 19(6): 903-912.

Lazetic et al., "Chimeric co-stimulatory molecules that selectively act through CD28 CTLA-4 on human T cells," J Biol Chem (2002)11;277(41):38660-38668.

Lee et al.. "Molecular mechanism of PD-1/PD-L1 blockade via anti-PD-L1 antibodies atezolizumab and durvalumab," Sci Rep (2017) 7(1):5532.

Leitner et al., "T cell stimulator cells, an efficient and versatile cellular system to assess the role of costimulatory ligands in the activation of human T cells," J Immunol Methods (2010) 362(1-2):131-141.

Levin et al., "Identification of a cell surface ligand for NKp30 (134.20)," J Immunol (2009) 182(1 Supplement) 134.20.

Levin et al., "Novel Immunomodulatory Proteins Generated via Directed Evolution of Variant IgSF Domains" Keystone Symposia on Molecular and Cellular Biology, Lymphocytes and their Roles in Cancer, Keystone, CO, Feb. 11-15, 2018, 1 page, presentation.

Levin et al., "Novel Immunomodulatory Proteins Generated via Directed Evolution of Variant IgSF Domains," Abstract for Keystone Symposia: Immune Regulation in Autoimmunity and Cancer, Whistler, British Columbia, Canada (Mar. 26-30, 2017), 1 page Available to Attendees Feb. 26, 2017.

Levin et al., "Novel Immunomodulatory Proteins Generated via Directed Evolution of Variant IgSF Domains," Poster presentation for Keystone Symposia: Immune Regulation in Autoimmunity and Cancer, Whistler, British Columbia, Canada (Mar. 26-30, 2017), 1 page.

Levin et al., "Tumor-Localizing NKp30/ICOSL vIgD Fusion Proteins Direct Effective Dual CD28/ICOS T cell Costimulation to B7-H6+ Tumor Cells in vitro and Tumors in vivo" Poster 2018 SITC (Nov. 7-11, 2018) Published Nov. 6, 2018.

Levin, S.D., et al., "Novel Immunomodulatory proteins generated via directed evolution of variant IgSF domains." Front Immunol., (2020) 10:3086.

Lewis et al., "Novel immunomodulatory proteins generated via directed evolution of variant IgSF domains," Abstract for Poster Presentation at the Federation of Clinical Immunology Societies Meeting, Chicago IL (Jun. 14, 2017) 2 pages Published after Apr. 7, 2017.

Lewis et al., "Novel immunomodulatory proteins generated via directed evolution of variant IgSF domains," Poster Presentation at the Federation of Clinical Immunology Societies Meeting, Chicago IL (Jun. 14, 2017).

Li et al., "Proteomics analysis reveals a Th17-prone cell population in presymptomatic graft-versus-host disease," JCI Insight. (2016) 1(6): e86660, 17 pages.

Lin et al., "The PD-1/PD-L1 complex resembles the antigen-binding Fv domains of antibodies and T cell receptors," Proc Natl Acad Sci U S A. (2008) 105(8):3011-3016.

Liu et al., "Combination B7-Fc Fusion Protein Treatment and Treg Cell Depletion Therapy," Clin Cancer Res (2005) 11(23):8492-8502.

Lundqvist et al., "31st Annual Meeting and Associated Programs of the Society for Immunotherapy of Cancer (SITC 2016): part one," J Immunother Cancer, (2016) 4(Suppl 1):82.

Lundqvist et al., "31st Annual Meeting and Associated Programs of the Society for Immunotherapy of Cancer (SITC 2016): part two," J Immunother Cancer, (2016) 4(Suppl 1):82.

Mandler et al., "Immunoconjugates of geldanamycin and anti-HER2 monoclonal antibodies: antiproliferative activity on human breast carcinoma cell lines," J Natl Cancer Inst. Oct. 4, 2000;92(19):1573-81.

Mandler et al., "Synthesis and evaluation of antiproliferative activity of a geldanamycin-Herceptin immunoconjugate," Bioorg Med Chem Lett. May 15, 2000;10(10):1025-8.

Mantovani et al., "Tumour-associated macrophages as treatment targets in oncology," Nat Rev Clin Oncol (2017) 14(7):399-416.

Marabelle et al., "Intratumoral immunotherapy: using the tumor as the remedy," Annals of Oncology (2017) 28: xii33-xii43.

Markey et al., "Conventional dendritic cells are the critical donor APC presenting alloantigen after experimental bone marrow transplantation", Blood. 2009 113(22):5644-5649.

Markey et al., "Flt-3L Expansion of Recipient CD8a + Dendritic Cells Deletes Alloreactive Donor T Cells and Represents an Alternative to Posttransplant Cyclophosphamide for the Prevention of GVHD", Clin Cancer Res. (2018) 24(7): 1604-1616.

Markey et al., "Recipient plasmacytoid DCs are not required to prime allogeneic T-cell responses after BMT," Blood. (2009) 113(23): 6038-6039.

(56) References Cited

OTHER PUBLICATIONS

Martin et al., "Increasingly frequent diagnosis of acute gastrointestinal graft-versushost disease after allogeneic hematopoietic cell transplantation," Biol Blood Marrow Transplant. (2004) 10(5): 320-327.

Mat Aki et al., "Expression of PD-1, PD-Li, and PD-L2 in the Liver in Autoimmune Liver Diseases," Am J Gastroenterol (2007) 102:302-312.

Maurer et al. (2020) ALPN-202 combines checkpoint inhibition with conditional T cell costimulation to overcome T cell suppression by M2c macrophages and improve the durability of engineered T cell anti-tumor responses [abstract]. In: Proceedings of the Annual Meeting of the American Association for Cancer Research.

Maurer et al., "Novel B7-Family-Based Immuno-Oncology Biologics Derived via Directed Evolution of IgSF Domains," Abstract for Society for Immunotherapy of Cancer's (SITC) 32nd Annual Meeting, National Harbor, MD (Nov. 8-12, 2017, Abs P343, 1 page.

Maute et al., "Engineering high-affinity PD-1 variants for optimized immunotherapy and immuno-PET imaging," Proc Natl Acad Sci USA, Nov. 2015, 112(47): E6506-E6514.

Mcdonald et al., "Plasma biomarkers of acute GVHD and non-relapse mortality: predictive value of measurements before GVHD onset and treatment," Blood. (2015) 126(1): 113-120, 33 ppages.

Mezzadra et al., "Identification of CMTM6 and CMTM4 as PD-LI protein regulators," Nature (2017) 549(7670):106-110.

Mochizuki et al., "Delta-like ligand 4 identifies a previously uncharacterized population of inflammatory dendritic cells that plays important roles in eliciting allogeneic T cell responses in mice," J Immunol. (2013) 190(7): 3772-3782.

Motzer et al., "Nivolumab plus Ipilimumab versus Sunitinib in Advanced Renal-Cell Carcinoma," N Engl J Med (2018) 378(14):1277-1290.

Chaudhri, Apoorvi, et al., "PD-L1 Binds to B7-1 Only in Cis on the Same Cell Surface," Cancer Immunology Research, Aug. 2018, vol. 6, No. 8, pp. 921-929.

Uniprot, Human PDL1, Q9NZQ7 PD1L1 Human, mutations, accessed on May 27, 2025.

"Database accession No. A0A2K5E9H6," Retrieved from Uniprot, https://www.uniprot.org/uniprot/A0A2K5E9H6. Retrieved Sep. 13, 2019, 1 page. Retrieved from Uniprot, https://www.uniprot.org/uniprot/A0A2K5Q1G1.txt.

"Database accession No. A0A2K5Q1G1" Retrieved from Uniprot, https://www.uniprot.org/uniprot/AOA2K5Q1G1.txt. Retrieved on Aug. 12, 2021, 2pages.

"Database accession No. AER57743 Human B7Rp1 extracellular domain (ECO)" Dated Apr. 19, 2007.

"Database accession No. AOA2J8M811," Retrieved from Uniprot, https://www.uniprot.org /uniprot/A0A2J8M811. Retrieved on Mar. 5, 2020, 2 pages.

"Database accession No. BDH56778," Retrieved from Geneseo, Retrieved on Sep. 13, 2019, 1 page.

"Database accession No. BDV07959," Retrieved from Geneseo, Retrieved on Sep. 12, 2019, 1 page.

"Database accession No. G3SBS5" Retrieved from Uniprot. https://www.uniprot.org/uniprot/G3SBS5.txt. Retrieved on Aug. 12, 2021, 2 pages.

"Database accession No. H9Z6Y0," version 15. Retrieved from Unisave, http://www.ebi.ac.uk/uniprot/unisave/app/#/content/H9Z6Y0/ 15. Retrieved on Jun. 20, 2017, 2 pages.

"Database accession No. L8Y5K4," version 13. Retrieved from Unisave, http://www.ebi.ac.uk/uniprot/unisave/app/#/content/L8Y5K4/ 13. Retrieved on Sep. 28, 2017, 1 page.

"Database accession No. NP 56074.1," version 1. Retrieved from NCBI, https://www.ncbi.nlm.nih.gov/protein /NP056074.1, Retrieved on Mar. 3, 2020, 4 pages.

Adorn et al., "ICOSL+ plasmacytoid dendritic cells as inducer of graft-versus-host disease, responsive to a dual ICOS/CD28 antagonist," Science Translational Medicine, Oct. 2020, 12(564): eaay4799, pp. 1-33.

Amatore et al., "Inducible Co-Stimulator (ICOS) as a Potential Therapeutic Target for Anti-Cancer Therapy," Expert Opinion on Therapeutic Targets, Apr. 2018, 22(4), pp. 343-351.

Auffermann-Gretzinger et al., "Rapid establishment of dendritic cell chimerism in allogeneic hematopoietic cell transplant recipients," Blood, the Journal of the American Society of Hematology, Feb. 2002, 99(4), pp. 1442-1448.

Australian Examination Report for Application No. 2018236224, dated Jan. 6, 2023, 5 pages.

Bachmann et al., "The EVH2 Domain of the Vasodilator-stimulated Phosphoprotein Mediates Tetramerization, F-actin Binding, and Actin Bundle Formation," Journal of Biology Chemistry, Aug. 1999, 274(33), pp. 23549-23557.

Banovic et al., "Graft-versus-host disease prevents the maturation of plasmacytoid dendritic cells," The Journal of Immunology, Jan. 2009, 182(2), pp. 912-920.

Bittner et al., "Subcutaneous Administration of Biotherapeutics: An Overview of Current Challenges and Opportunities," BioDrugs (2018) 32:425-440.

Buchbinder et al., "CTLA-4 and PD-1 Pathways Similarities, Differences, and Implications of Their Inhibition," American Journal of Clinical Oncology, vol. 39, No. 1, Feb. 2016, pp. 98-106, https:// pubmed.ncbi.nlm.nih.gov/26558876/.

Busch et al., "Dimers, leucine zippers and DNA-binding domains," Trends Genet. (1990) 6(2): 36-40.

Butte et al., "Interaction of human PD-L1 and B7-1," Molecular Immunology, Aug. 2008, 45: 3567-3572.

Butte et al., "Programmed death-1 ligand 1 interacts specifically with the B7-1 costimulatory molecule to inhibit T cell responses," Immunity (2007) 27(1):111-122.

Canadian Examination Report for Application No. 3053804, dated Dec. 28, 2022, 7 pages.

Chen et al., "MolProbity: all-atom structure validation for macromolecular crystallography," Acra Crystallogr D Biol Crystallogr (2010) 66(Pt 1):12-21.

Cogswell et al., "An Analytical Comparison of Dako 28-8 PharmDx Assay and an E1L3N Laboratory-Developed Test in the Immunohistochemical Detection of Programmed Death-Ligand 1," Mol Diagn Ther (2017) 21(1): 85-93.

Corpet, "Multiple sequence alignment with hierarchical clustering," Nucleic Acids Res. (1988) 16(22): 10881-10890. (URL: multalin. toulouse.inra.fr/multalin/multalin.html.).

Covassin et al., "Human peripheral blood CD4 T cell-engrafted non-obese diabeticscid IL2ry(null) H2-Abl (tmlGru) Tg (human leucocyte antigen D-related 4) mice: a mouse model of human allogeneic graft-versus-host disease," Clinical & Experimental Immunology, Nov. 2011, 166(2), pp. 269-280.

Davis et al., "Macrophage M1/M2 polarization dynamically adapts to changes in cytokine microenvironments in Cryptococcus neoformans infection," M Bio (2013) 4(3):e00264.

De Filipe et al., "Use of the 2A sequence from foot-and-mouth disease virus in the generation of retroviral vectors for gene therapy," Gene Therapy (1999) 6:198-208.

Despoix et al., "Mouse CD146/MCAM is a marker of natural killer cell maturation". European Journal of Immunology, Oct. 2008, 38(10), pp. 2855-2864.

Ehx et al., "Xenogeneic Graft-Versus-Host Disease in Humanized NSG and NSGHLAA2/HHD Mice", Frontiers of Immunology, Aug. 2018, 9, article 1943, pp. 1-16.

Emsley et al., "Features and development of Coot," Acta Crystallogr D Biol Crystallogr (2010) 66(Pt 4):486-501.

Evans et al., "Crystal structure of a soluble CD28-Fab complex," Nat Immunol (2005) 6(3):271-279.

Evans et al., "Generation of Novel Immuno-Oncology Biologics via Directed Evolution of Variant IgSF Domains," Poster Presentation for Immune Checkpoint Inhibitors, Boston, MA (Mar. 14-16, 2017) 1 page.

Fargeas et al., "Identification of residues in the V domain of CD80 (B7-1) implicated in functional interaction with CD28 and CTLA4", Journal of Experimental Medicine, vol. 182, No. 3. Sep. 1, 1995 pp. 667-675.

(56) References Cited

OTHER PUBLICATIONS

Ferrara et al., "Regenerating islet-derived 3-alpha is a biomarker of gastrointestinal graft-versus-host disease," Blood, the Journal of the American Society of Hematology, Dec. 2011, 118(25), pp. 6702-6708.

Forcade et al., "An activated Th17-prone T cell subset involved in chronic graft-versus-host disease sensitive to pharmacological inhibition," JCI Insight, Jun. 2017, 2(12): e92111, pp. 1-15.

Ford et al., "Targeting co-stimulatory pathways: transplantation and autoimmunity," Nat Rev Nephrol. (2014) 10(1):14-24.

Fowler et al., "R707, a fully human antibody directed against CC-chemokine receptor 7, attenuates xenogeneic acute graft-versus-host disease," American Journal of Transplantation, Jul. 2019, 19(7), pp. 1941-1954.

Freeman, G.J. et al. Engagement of the PD-1 immunoinhibitory receptor by a novel B7 family member leads to negative regulation of lymphocyte activation. J. Exp. Med., 2000, 192(7): 1027-1034.

Geneseq, "Database accession No. BD020821," Retrieved from https://www.ebi.ac.uk/ena/data/view/BD020821. Retrieved on May 16, 2018.

Geneseq, "Database accession No. BD020825," Retrieved from https://www.ebi.ac.uk/ena/data/view/BD020825. Retrieved on May 16, 2018.

Gentz et al., "Parallel association of Fos and Jun leucine zippers juxtaposes DNA binding domains," Science. (1989) 243(4899): 1695-1699.

Gill et al., "Calculation of protein extinction coefficients from amino acid sequence data," Anal Biochem (1989) 182(2):319-326.

Gunasekaran et al., "Enhancing antibody Fc heterodimer formation through electrostatic steering effects: applications to bispecific molecules and monovalent IgG," J Biol Chem (2010) 285(25):19637-19646.

Haile et al., "A Soluble Form of CD80 Enhances Antitumor Immunity by Neutralizing Programmed Death Ligand-1and Simultaneously Providing Costimulation," Cancer Immunol Res (2014) 2(7): 610-615.

Hartwell et al., "An early-biomarker algorithm predicts lethal graft-versus-host disease and survival," JCI Insight. (2017) 2(3): e89798.

Horn et al., "Soluble CD80 Protein Delays Tumor Growth and Promotes Tumor-Infiltrating Lymphocytes," Cancer Immunol Res. (2018) 6(1): 59-68.

Hoseini et al., "A potent tetravalent T-cell-engaging bispecific antibody against CD33 in acute myeloid leukemia", Blood Adv. Jun. 12, 2018;2(11):1250-1258.

Hu et al., "The M2 phenotype of tumor-associated macrophages in the stroma confers a poor prognosis in pancreatic cancer," Tumour Biol (2016) 37(7):8657-8764.

Hui et al., "T cell costimulatory receptor CD28 is a primary target for PD-1-mediated inhibition," Science (2017) 355(6332):1428-1433.

U.S. Appl. No. 17/161,584, filed Jan. 28, 2021, Ryan Swanson et al. (Copy not provided).

U.S. Appl. No. 17/161,586, filed Jan. 28, 2021, Ryan Swanson et al. (Copy not provided).

U.S. Appl. No. 17/161,593, filed Jan. 28, 2021, Ryan Swanson et al. (Copy not provided).

U.S. Appl. No. 17/163,205, filed Jan. 29, 2021, Ryan Swanson et al. (Copy not provided).

U.S. Appl. No. 17/275,646, filed Mar. 11, 2021, Ryan Swanson et al. (Copy not provided).

U.S. Appl. No. 16/321,000, filed Jan. 25, 2019, by Swanson et al. (Copy not provided).

U.S. Appl. No. 16/343,709, filed Apr. 19, 2019, by Swanson et al. (Copy not provided).

U.S. Appl. No. 16/493,750, filed Sep. 12, 2019, by Swanson et al. (Copy not provided).

U.S. Appl. No. 16/493,751, filed Sep. 12, 2019, by Swanson et al. (Copy not provided).

U.S. Appl. No. 16/493,752, filed Sep. 12, 2019, by Swanson et al. (Copy not provided).

U.S. Appl. No. 16/959,662, filed Jan. 3, 2019, by Swanson et al. (Copy not provided).

U.S. Appl. No. 17/252,233, filed Dec. 14, 2020, by Swanson et al. (Copy not provided).

U.S. Appl. No. 17/275,646, filed Mar. 11, 2020, by Swanson et al. (Copy not provided).

Uzzaman et al., "Classification of hypersensitivity reactions," Allergy Asthma Proc. (2012) 33: S96-S99.

Vagin et al., "Molecular replacement with MOLREP," Acta Crystallographica Section D (2010) 66(1):22-25.

Van Der Lugt et al., "ST2 as a marker for risk of therapy-resistant graft-versus-host disease and death," N Engl J Med. (2013) 369(6): 529-539.

Vessillier et al., "Cytokine release assays for the prediction of therapeutic mAb safety in first-in man trials—Whole blood cytokine release assays are poorly predictive for TGN1412 cytokine storm," J Immunol Methods (2015) 424:43-52.

Voulgaraki et al., "Multivalent recombinant proteins for probing functions of leucocyte surface proteins such as the CD200 receptor," Immunology. (2005) 115(3):337-346.

Watkins et al., "CD28 blockade controls T cell activation to prevent graft-versus-host disease in primates", J Clin Invest. (2018) 128(9): 3991-4007.

Wei et al., "Distinct Cellular Mechanisms Underlie Anti-CTLA-4 and Anti-PD-1 Checkpoint Blockade," Cell (2017) 170(6):1120-1133.

Wei et al., "Strength of PD-1 signaling differentially affects T-cell effector functions," PNAS (2013) 110(27):E2480-E2489.

Whitlow et al., "An improved linker for single-chain Fv with reduced aggregation and enhanced proteolytic stability," Protein Eng (1993) 6(8):989-995.

Wikenheiser et al., "ICOS Co-Stimulation: Friend or Foe?," Front Immunol (2016) (7):304, 16 pgs.

Wilson et al., Analyzing biomolecular interactions, Science. (2002) 295(5562): 2103-2105.

Winn et al., "Overview of the CCP4 suite and current developments," Acta Crystallogr D Biol Crystallogr (2011) 67(Pt 4):235-242.

Wolchok et al., "Overall Survival with Combined Nivolumab and Ipilimumab in Advanced Melanoma," N Engl J Med (2017) 377(14):1345-1356.

Wolff et al., "Monoclonal Antibody Homodimers: Enhanced Antitumor Activity in Nude Mice," Cancer Res. (1993) 53 (11): 2560-2565.

Xu et al., "Affinity and cross-reactivity engineering of CTLA4-Ig to modulate T cell costimulation," J Immunol (2012) 189(9):4470-4477.

Yang et al., "First-in-human study of the safety, tolerability, pharmacokinetics, and pharmacodynamics of ALPN-101, a dual CD28/ICOS antagonist, in healthy adult subjects," Clin Transl Sci (2021) DOI: 10.1111/cts.12983.

Yokosuka et al., "Programmed cell death 1 forms negative costimulatory microclusters that directly inhibit T cell receptor signaling by recruiting phosphatase SHP2," J Exp Med (2012) 209(6):1201-1217.

Zak et al., "Structure of the Complex of Human Programmed Death 1, PD-1, and Its Ligand PD-L1," Structure (2015) 23(12):2341-2348.

Zamani et al., "PD-1/PD-L and autoimmunity: A growing relationship," Cell Immunol (2016) 310:27-41.

Zapata et al., "Engineering linear F(ab')2 fragments for efficient production in *Escherichia coli* and enhanced antiproliferative activity," Protein Eng. (1995) 8(10):1057-62.

Zeiser Robert et al., "Acute graft-versus-host disease biological process, prevention and therapy," N. Engl. J. Med., Nov. 30, 2017, 377(22), 2167-2179.

Zhang et al., "Crystal structure of the receptor-binding domain of human B7-2: insights into organization and signaling," Proc Natl Acad Sci US A. (2003) 100(5):2586-2591.

(56) References Cited

OTHER PUBLICATIONS

Zhang et al., "Identification of another primordial CD80/86 molecule in rainbow trout: insights into the origin and evolution of CD80 and CD86 in vertebrates," Developmental & Comparative Immunology (2018) 89:73-82.

Zhang et al., "Immunoinhibitory checkpoint deficiency in medium and large vessel vasculitis," PNAS (2017) 114(6):E970-E979.

Zhang et al., "Introduction to the Data Analysis of the Roche xCELLigence®System with RTCA Package," Bioconductor. May 3, 2016, bioconductor.org/packages/devel/bioc/vignettes/RTCA/inst/doc/aboutRTCA.pdf, accessed Sep. 9, 2016, 11 pages.

Zhang et al., "Preterminal host dendritic cells in irradiated mice prime CD8+ T cell-mediated acute graft-versus-host disease," J Clin Invest. (2002) 109(10): 1335-1344.

Zhang et al., "ST2 blockade reduces sST2-producing T cells while maintaining protective mST2-expressing T cells during graft-versus-host disease", Sci Transl Med. (2015) 7(308): 308ra 160, 27 pages.

Zhang et al., "Structural basis of a novel PD-L1 nanobody for immune checkpoint blockade," Cell Discov (2017) 3:17004.

Zhao et al., "Antigen-Presenting Cell-Intrinsic PD-1 Neutralizes PD-L1 in cis to Attenuate PD-1 Signaling in T Cells," Cell Rep (2018) 24(2):379-390.

Zhong et al., "Lower expression of PD-1 and PD-LI in peripheral blood from patients with chronic ITP," Hematology (2016) 21(9):552-557.

Zhou et al., "Endogenous programmed death ligand-1 restrains the development and onset of Sjogren's syndrome in non-obese diabetic mice," Scientific Reports. (2016) vol. 6; Article No. 39105, 12 pages.

Zimin et al., "A new rhesus macaque assembly and annotation for next-generation sequencing analyses," Biology Direct, Oct. 2014, 9(1), pp. 1-15.

Bowie et al., Deciphering the message in Protein Sequences: Tolerance to amino acid substitutions, Science, 247 (4948):1306-1310 (1990).

European Search Report for Application No. 19704899.4 dated Jan. 11, 2022, 4 pages.

GenBank Accession No. AOC21470.1, Sequence 2006 from patent U.S. Pat. No. 9,150,664, Aug. 14, 2016, retrieved from , downloaded on Aug. 13, 2024, 1 page.

Hou et al., A transendocytosis model of CTLA-4 function predicts its suppressive behavior on regulatory T cells, J. Immunol., 194(5):2148-2159 (2015).

International Application No. PCT/US2018/022265, International Preliminary Report on Patentability, mailed Sep. 26, 2019.

International Application No. PCT/US2018/022265, Invitation to Pay Additional Fees, mailed Jun. 15, 2018.

Koenen et al., A novel bispecific antihuman CD40/CD86 fusion protein with T-cell tolerizing potential, Transplantation, 78(10): 1429-1438 (2004).

Lorenzetti, et al., Abatacept modulates CD80 and CD86 expression and memory formation in human B-cells, Journal of Autoimmunity, 101:145-152 (2019).

Maurer et al., ALPN-202, a conditional CD28 costimulatory and dual checkpoint inhibitor utilizes multiple mechanisms to elicit potent anti-tumor immunity superior to checkpoint blockade alone, Journal for Immunotherapy of Cancer, 7 (Suppl 1); P793, Abstract SITC 2019, 2 pages.

Mizuhara et al., T cell activation-associated hepatic injury: mediation by tumor necrosis factors and protection by interleukin 6, J. Exp. Med., 179(5):1529-1537 (1994).

Mkaddem et al., Understanding Fc Receptor Involvement in Inflammatory Diseases: From Mechanisms to New Therapeutic Tools, Frontiers in Immunology, 10:811 (2019).

Moreland et al., Abatacept, Nat. Rev. Drug Discov., 5(3): 185-186 (2006).

Partial European Search Report for Application No. 18793148.0, mailed Mar. 16, 2023, 3 pages.

Partial European Search Report for European Application No. 23153416.5 dated Aug. 4, 2023, 15 pages.

Qureshi et al., Trans-endocytosis of CD80 and CD86: a molecular basis for the cell-extrinsic function of CTLA-4, Science, 332(6029):600-603 (2011).

Read et al., Cutting edge: Identification of neutrophil PGLYRP1 as a ligand for TREM-1, J. Immunology, 194:1417-1421 (2015).

Rixon et al., Novel immunomodulatory proteins generated via directed evolution of variant IgSF domains, PEGS: The Essential Protein Engineering Summit, Boston, MA, Apr. 30-May 1, 2018, 1 page. Abstract.

Rixon et al., Novel immunomodulatory proteins generated via directed evolution of variant IgSF domains, PEGS: The Essential Protein Engineering Summit, Boston, MA, Apr. 30-May 1, 2018, 1 page. Presentation.

Sathish, et al., Challenges and approaches for the development of safer immunomodulatory biologics, Nature Reviews Drug Discovery, 12(4):306-324 (2013).

Soskic et al., Capter Four - A transendocytosis perspecitve on the CD28/CTLA-4 pathway, Advance in Immunology, 124:95-136 (2014).

Swanson, et al., Therapeutic T cell activation using engineered variant IgSF domains, Abstract for Society for Immunotherapy of Cancer, National Harbor, MD (Nov. 9-13, 2016), 1 page Published Nov. 8, 2016.

Tiegs et al., A T cell-dependent experimental liver injury in mice inducible by concanavalin A, J. Clin. Invest., 90(1):196-203 (1992).

Toyabe et al., Requirement of IL-4 and liver NK1+ T cells for concanavalin A-induced hepatic injury in mice, J. Immunol., 159:1537-1542 (1997).

U.S. Appl. No. 16/320,981, filed Jan. 25, 2019, by Swanson et al. (Copy not provided).

U.S. Appl. No. 17/163,257, filed Jan. 29, 2021, by Swanson et al. (Copy not provided).

Wells, Additivity of mutational effects in proteins, Biochemistry, 29(37):8509-8517 (1990).

Soluble vIgD (e.g. vIgD-Fc)

Stack Molecule

Tumor targeting vIgD antibody and vIgD conjugate (V-Mab)

CD155 VARIANT IMMUNOMODULATORY PROTEINS AND USES THEREOF

CROSS-REFERENCE TO RELATED APPLICATIONS

This application is a divisional of U.S. application Ser. No. 16/320,981 filed on Jan. 25, 2019 which is a National Stage application under 35 U.S.C. § 371 of International Application No. PCT/US2017/044261, filed on Jul. 27, 2017, which claims priority from U.S. provisional application No. 62/367,822, filed Jul. 28, 2016, U.S. provisional application No. 62/394,696, filed Sep. 14, 2016, U.S. provisional application No. 62/410,839, filed Oct. 20, 2016, U.S. provisional application No. 62/472,558, filed Mar. 16, 2017, and U.S. provisional application No. 62/475,196, filed Mar. 22, 2017, the contents of each of which are hereby incorporated by reference in their entirety.

INCORPORATION BY REFERENCE OF SEQUENCE LISTING

The present application is being filed along with a Sequence Listing in XML format. The Sequence Listing is provided as a file entitled 761612000510SEQLIST.xml, created Oct. 13, 2022 which is 2,910,218 bytes in size. The information in the electronic format of the Sequence Listing is incorporated by reference in its entirety.

FIELD

The present disclosure relates to therapeutic compositions for modulating immune response in the treatment of cancer and immunological diseases. In some aspects, the present disclosure relates to particular variants of CD155 that exhibit improved binding, such as improved binding affinity or selectivity, for one or more of the cognate binding partner proteins TIGIT, CD226 or CD96.

BACKGROUND

Modulation of the immune response by intervening in the processes that occur in the immunological synapse (IS) formed by and between antigen-presenting cells (APCs) or target cells and lymphocytes is of increasing medical interest. Mechanistically, cell surface proteins in the IS can involve the coordinated and often simultaneous interaction of multiple protein targets with a single protein to which they bind. IS interactions occur in close association with the junction of two cells, and a single protein in this structure can interact with both a protein on the same cell (cis) as well as a protein on the associated cell (trans), likely at the same time. Although therapeutics are known that can modulate the IS, improved therapeutics are needed. Provided are immunomodulatory proteins, including soluble proteins or transmembrane immunomodulatory proteins capable of being expressed on cells, that meet such needs.

SUMMARY

Provided herein are variant CD155 polypeptides. In some embodiments, the variant CD155 polypeptides comprise an IgV domain or a specific binding fragment thereof, an IgC domain or a specific binding fragment thereof, or both, wherein the variant CD155 polypeptide comprises one or more amino acid modifications in an unmodified CD155 or a specific binding fragment thereof corresponding to position(s) selected from 7, 8, 9, 10, 11, 12, 13, 15, 16, 18, 19, 20, 21, 22, 23, 24, 25, 26, 29, 30, 32, 33, 34, 35, 36, 37, 38, 39, 40, 41, 42, 44, 45, 46, 47, 48, 49, 50, 51, 52, 53, 54, 55, 56, 57, 58, 59, 60, 61, 62, 64, 65, 67, 68, 69, 70, 72, 73, 75, 76, 77, 78, 79, 80, 81, 82, 83, 84, 85, 87, 88, 89, 90, 91, 92, 94, 95, 96, 97, 98, 99, 100, 102, 104, 106, 107, 108, 110, 111, 112, 113, 114, 115, or 116 with reference to positions set forth in SEQ ID NO: 47. In some embodiments, the amino acid modifications comprise amino acid substitutions, deletions or insertions. In some embodiments, the unmodified CD155 is a mammalian CD155 or a specific binding fragment thereof. In some embodiments, the unmodified CD155 is a human CD155 or a specific binding fragment thereof. In some embodiments, the unmodified CD155 comprises (i) the sequence of amino acids set forth in SEQ ID NO: 47, (ii) a sequence of amino acids that has at least 95% sequence identity to SEQ ID NO: 47; or (iii) a portion thereof comprising an IgV domain or specific binding fragment thereof.

In some embodiments of any one of the variant CD155 polypeptides, the specific binding fragment of the IgV domain has a length of at least 50, 60, 70, 80, 90, 100, 110 or more amino acids; or the specific binding fragment of the IgV domain comprises a length that is at least 80% of the length of the IgV domain set forth as amino acids 24-139 of SEQ ID NO: 20. In some embodiments, the variant CD155 polypeptide comprises up to 1, 2, 3, 4, 5, 6, 7, 8, 9, 10, 11, 12, 13, 14, 15, 16, 17, 18, 19 or 20 amino acid modifications, optionally amino acid substitutions, insertions and/or deletions. In some embodiments, the variant CD155 comprises a sequence of amino acids that exhibits at least 85%, 86%, 87%, 88%, 89%, 90%, 91%, 92%, 93%, 94%, 95%, 96%, 97%, 98% or 99% sequence identity to SEQ ID NO: 47 or a specific binding fragment thereof. In some embodiments, the variant CD155 polypeptide exhibits altered binding to the ectodomain of TIGIT, CD226 or CD96 compared to the unmodified CD155. In some embodiments, the variant CD155 polypeptide exhibits altered binding to the ectodomain of TIGIT or CD226 compared to the unmodified CD155. In some embodiments, the altered binding is altered binding affinity and/or altered binding selectivity.

In some embodiments of any one of the variant CD155 polypeptides, the one or more amino acid modifications are selected from G7E, D8G, V9A, V9D, V9I, V9L, V10F, V10G, V10I, V11A, V11E, V11M, Q12H, Q12K, Q12L, A13E, A13R, T15I, T15S, Q16H, P18C, P18F, P18H, P18L, P18S, P18T, P18Y, G19D, F20I, F20S, F20Y, L21S, L21M, G22S, D23A, D23G, D23N, D23Y, S24A, S24P, V25A, V25E, T26M, C29R, Y30C, Y30F, Y30H, Q32L, Q32R, V33M, P34S, N35D, N35F, N35S, M36I, M36R, M36T, E37G, E37P, E37S, E37V, V38A, V38G, T39A, T39S, H40Q, H40R, H40T, V41A, V41M, S42A, S42C, S42G, S42L, S42N, S42P, S42Q, S42T, S42V, S42W, L44P, L44V, T45A, T45G, T45I, T45S, T45Q, T45V, W46C, W46R, A47E, A47G, A47V, R48Q, H49L, H49Q, H49R, G50S, E51G, E51K, E51V, S52A, S52E, S52G, S52K, S52L, S52M, S52P, S52Q, S52R, S52T, S52W, G53R, S54C, S54G, S54H, S54N, S54R, M55I, M55L, M55V, A56V, V57A, V57L, V57T, F58L, F58Y, H59E, H59N, N59R, Q60H, Q60K, Q60P, Q60R, T61A, T61G, T61K, T61M, T61R, T61S, Q62F, Q62H, Q62K, Q62L, Q62M, Q62R, Q62Y, P64S, S65A, S65C, S65G, S65D, S65T, S65Y, S65H, S65N, S65T, S65W, S67A, S67E, S67G, S67H, S67L, S67T, S67V, S67W, E68D, E68G, S69L, S69P, K70E, K70R, K70Q, L72Q, E73D, E73G, E73R, V75A, V75L, A76E, A76G, A76T, A77T, A77V, R78G, R78K, R78S, L79P, L79Q, L79V, G80D, G80S, A81E, A81P, A81T, A81V, E82D, E82G, L83P, L83Q, R84W, N85D, N85Y, N87T, L88P, R89K, M90I, M90L, M90V, F91S, F91T, F91P, G92A, G92E, G92W, R94H, V95A, E96D, D97G, E98D, E98S, G99D, G99Y, N100Y, T102S, L104E, L104M, L104N, L104P, L104Q, L104T, L104Y, V106A, V106I, V106L, T107A, T107L, T107M, T107S, T107V, F108H, F108L, F108Y, Q110R, G111D, G111R, S112I, S112N, S112V, R113G, R113W, S114N, S114T, V115A, V115M, D116G, or D116N, or a conservative amino acid substitution thereof. In some embodiments, the one or more amino acid modifications are selected from P18S/P64S/F91S, P18S/ F91S/L104P, P18L/L79V/F91S, P18S/F91S, P18T/F91S, P18T/S42P/F91S, G7E/P18T/Y30C/F91S, P18T/F91S/ G111D, P18S/F91P, P18T/F91S/F108L, P18S/F91S, P18T/ T45A/F91S, P18T/F91S/R94H, P18S/Y30C/F91S, A81V/ L83P, A13E/P18S/A56V/F91S, P18T/F91S/V115A, P18T/ Q60K, S52M, T45Q/S52L/L104E/G111R, S42G, Q62F, S52Q, S42A/L104Q/G111R, S42A/S52Q/L104Q/G111R, S52W/L104E, S42C, S52W, S52M/L104Q, S42L/S52L/ Q62F/L104Q, S42W, S42Q, S52L, S52R, L104E, GI IR, S52E, Q62Y, T45Q/S52M/L104E, S42N/L104Q/G111R, S52M/V57L, S42N/S52Q/Q62F, S42A/S52L/L104E/ G111R, S42W/S52Q/V57L/Q62Y, L104Q, S42L/S52Q/ L104E, S42C/S52L, S42W/S52R/Q62Y/L104Q, T45Q/ S52R/L104E, S52R/Q62F/L104Q/G111R, T45Q/S52L/ V57L/L104E, S52M/Q62Y, Q62F/L104E/G111R, T45Q/ S52Q, S52L/L104E, S42V/S52E, T45Q/S52R/G111R, S42G/S52Q/L104E/G111R, S42N/S52E/V57L/L104E, S42C/S52M/Q62F, S42L, S42A, S42G/S52L/Q62F/L104Q, S42N, P18T/S65A/S67V/F91S, P18F/T39A/T45Q/T61R/ S65N/S67L/E73G/R78G, P18T/T45Q/T61R/S65N/S67L, P18F/S65A/S67V/F91S, P18F/T45Q/T61R/S65N/S67L/ F91S/L104P, P18S/L79P/L104M, P18S/L104M, L79P/ L104M, P18T/T45Q/L79P, P18T/T45Q/T61R/S65H/S67H, P18T/A81E, P18S/D23Y/E37P/S52G/Q62M/G80S/A81P/ G99Y/S 112N, A13R/D23Y/E37P/S42P/Q62Y/A81E, A13R/D23Y/E37P/G99Y/S112N, A13R/D23Y/E37P/ Q62M/A77V/G80S/A81P/G99Y, P18L/E37S/Q62M/G80S/ A81P/G99Y/S112N, P18S/L104T, P18S/Q62H/L79Q/ F91S, T45Q/S52K/Q62F/L104Q/G111R, T45Q/S52Q/ Q62Y/L104Q/G111R, T45Q/S52Q/Q62Y/L104E/G111R, V57A/T61M/S65W/S67A/E96D/L104T, P18L/V57T/ T61S/S65Y/S67A/L104T, P18T/T45Q, P18L/V57A/T61M/ S65W/S67A/L104T, T61M/S65W/S67A/L104T, P18S/ V41A/S42G/T45G/L104N, P18H/S42G/T45I/S52T/G53R/ S54H/V57L/H59E/T61S/S65D/E68G/L104N, P18S/S42G/ T45V/F58L/S67W/L104N, P18S/T45I/L104N, P18S/S42G/ T45G/L104N/V106A, P18H/H40R/S42G/T45I/S52T/ G53R/S54H/V57L/H59E/T61S/S65D/E68G/L104Y/ V106L/F108H, E37V/S42G/T45G/L104N, P18S/T45Q/ L79P/L104T, P18L/Q62R, A13R/D23Y/E37P/S42L/S52G/ Q62Y/A81E, P18L/H49R/L104T/D116N, A13R/D23Y/ E37P/Q62M/G80S/A81P/L104T, S65T/L104T, A13R/ D23Y/E37P/S52G/V57A/Q62M/K70E/L104T, P18L/ A47V/Q62Y/E73D/L104T, H40T/V411M/A47V/S52Q/ Q62L/S65T/E73R/D97G/E98S/L104T/D116N, P18L/S42P/ T45Q/T61G/S65H/S67E/L104T/D116N, P18S/H40T/ V41M/A47V/S52Q/Q62L/S65T/E73R/L104M/V106A, H40T/V41M/A47V/S52Q/Q62L/S65T/E68G/E73R/D97G/ E98S/L104T, T45Q/S52E/L104E, T45Q/S52E/Q62F/ L104E, P18F/T26M/L44V/Q62K/L79P/F91S/104M/ G111D, P18S/T45S/T61K/S65W/S67A/F91S/G111R, P18S/L79P/L104M/T107M, P18S/S65W/S67A/M90V/ V95A/L104Q/G111R, P18S/A47G/L79P/F91S/L104M/ T107A/R113W, P18T/D23G/S24A/N35D/H49L/L79P/ F91S/L104M/G111R, V9L/P18S/Q60R/V75L/L79P/R89K/ F91S/L104E/G111R, P18S/H49R/E73D/L79P/N85D/F91S/

V95A/L104M/G111R, V11A/P18S/L79P/F91S/L104M/ G111R, V11A/P18S/S54R/Q60P/Q62K/L79P/N85D/F91S/ T107M, P18T/S52P/S65A/S67V/L79P/F91S/L104M/ G111R, P18T/M36T/L79P/F91S/G111R, D8G/P18S/M36I/ V38A/H49Q/A76E/F91S/L104M/T107A/R113W, P18S/ S52P/S65A/S67V/L79P/F91S/L104M/T107S/R113W, T15I/P18T/L79P/F91S/L104M/G111R, P18F/T26M/L44V/ Q62K/L79P/E82D/F91S/L104M/G111D, P18T/E37G/ G53R/Q62K/L79P/F91S/E98D/L104M/T107M, P18L/ K70E/L79P/F91S/V95A/G111R, V9I/Q12K/P18F/S65A/ S67V/L79P/L104T/G111R/S112I, P18F/S65A/S67V/F91S/ L104M/G111R, V9I/V10I/P18S/F20S/T45A/L79P/F91S/ L104M/F108Y/G111R/S112V, V9L/P18L/L79P/M90I/ F91S/T102S/L104M/G111R, P18C/T26M/L44V/M55I/ Q62K/L79P/F91S/L104M/T107M, V9I/P18T/D23G/L79P/ F91S/G111R, P18F/L79P/M90L/F91S/V95A/L104M/ G111R, P18T/M36T/S65A/S67E/L79Q/A81T/F91S/ G111R, V9L/P18T/Q62R/L79P/F91S/L104M/G111R, P18S/S65W/S67A/L104Q/G111R, P18T/G19D/M36T/ S54N/L79P/L83Q/F91S/T107M/F108Y, V9L/P18L/M55V/ S69L/L79P/A81E/F91S/T107M, P18F/H40Q/T61K/Q62K/ L79P/F91S/L104M/T107V, P18S/Q32R/Q62K/R78G/ L79P/F91S/T107A/R113W, Q12H/P18T/L21S/G22S/ V57A/Q62R/L79P/F91S/T107M, V9I/P18S/S24P/H49Q/ F58Y/Q60R/Q62K/L79P/F91S/T107M, P18T/W46C/ H49R/S65A/S67V/A76T/L79P/S87T/L104M, P18S/S42T/ E51G/L79P/F91S/G92W/T107M, V10F/T15S/P18L/R48Q/ L79P/F91S/T107M/V115M, P18S/L21M/Y30F/N35D/ R84W/F91S/T107M/D116G, P18F/E51V/S54G/Q60R/ L79Q/E82G/S87T/M901/F91S/G92R/T107M, Q16H/P18F/ F91S/T107M, P18T/D23G/Q60R/S67L/L79P/F91S/ T107M/V115A, D8G/V9I/V11A/P18T/T26M/S52P/L79P/ F91S/G92A/T107L/V115A, V9I/P18F/A47E/G50S/E68G/ L79P/F91S/T107M, P18S/M55I/Q62K/S69P/L79P/F91S/ T107M, P18T/T39S/S52P/S54R/L79P/F91S/T107M, P18S/ D23N/L79P/F91S/T107M/S114N, P18S/P34S/E51V/L79P/ F91S/G111R, P18S/H59N/V75A/L79P/A81T/F91S/ L104M/T107M, P18S/W46R/E68D/L79P/F91S/T107M/ R113G, V9L/P18F/T45A/S65A/S67V/R78K/L79V/F91S/ T107M/S114T, P18T/M55L/T61R/L79P/F91S/V106I/ T107M, T15I/P18S/V33M/N35F/T39S/M55L/R78S/L79P/ F91S/T107M, P18S/Q62K/K70E/L79P/F91S/G92E/ R113W, P18F/F20I/T26M/A47V/E51K/L79P/F91S, P18T/ D23A/Q60H/L79P/M90V/F91S/T107M, P18S/D23G/ C29R/N35D/E37G/M55I/Q62K/S65A/S67G/R78G/L79P/ F91S/L104M/T107M/Q110R, A13E/P18S/M36R/Q62K/ S67T/L79P/N85D/F91S/T107M, V9I/P18T/H49R/L79P/ N85D/F91S/L104T/T107M, V9A/P18F/T61S/Q62L/L79P/ F91S/G111R, D8E/P18T/T61A/L79P/F91S/T107M, P18S/ V41A/H49R/S54C/L79S/N85Y/L88P/F91S/L104M/ T107M, V 11E/P18H/F20Y/V25E/N35S/H49R/L79P/F91S/ T107M/G111R, V11A/P18F/D23A/L79P/G80D/V95A/ T107M, P18S/K70R/L79P/F91S/G111R, V9L/V11M/P18S/ N35S/S54G/Q62K/L79P/L104M/T107M/V115M, V9L/ P18Y/V25A/V38G/M55V/A77T/L79P/M90I/F91S/ L104M, V10G/P18T/L72Q/L79P/F91S/T107M, P18S/ H59R/A76G/R78S/L79P, V9A/P18S/M36T/S65G/L79P/ F91S/L104T/G111R/S112I, P18T/S52A/V57A/Q60R/ Q62K/S65C/L79P/F91T/N100Y/T107M, V11A/P18F/ N35D/A47E/Q62K/L79P/F91S/G99D/T107M/S114N, V11A/P18T/N35S/L79P/S87T/F91S, V9D/V11M/Q12L/ P18S/E37V/M55I/Q60R/K70Q/L79P/F91S/L104M/ T107M, or T15S/P18S/Y30H/Q32L/Q62R/L79P/F91S/ T107M.

In some embodiments of any one of the variant CD155 polypeptides, the variant CD155 polypeptide comprises one IgC domain or two IgC domains or a specific fragment thereof.

In some embodiments of any one of the variant CD155 polypeptides, the sequence of amino acids set forth in any of SEQ ID NOS: 59-80, 178-274, 1230-1252, 1269, and 1610-1655 or a specific binding fragment thereof, or a sequence of amino acids that exhibits at least 95% sequence identity to any of SEQ ID NOS: 59-80, 178-274, 1230-1252, 1269, and 1610-1655 or a specific binding fragment thereof and that contains the one or more of the amino acid substitutions.

In some embodiments of any one of the variant CD155 polypeptides, the unmodified CD155 comprises an IgV domain or specific binding fragment thereof comprising (i) the sequence of amino acids set forth in SEQ ID NO: 58 or 155, (ii) a sequence of amino acids that has at least 95% sequence identity to SEQ ID NO: 58 or 155; or (iii) a portion thereof comprising a specific binding fragment thereof. In some embodiments of any one of the variant CD155 polypeptides, the variant CD155 polypeptide comprises the IgV domain or a specific binding fragment thereof. In some embodiments, the IgV domain or specific binding fragment thereof is the only CD155 portion of the variant CD155 polypeptide.

In some embodiments of any one of the variant CD155 polypeptides, the variant CD155 polypeptide comprises the sequence of amino acids set forth in any of SEQ ID NOS: 81-102, 156-177, 275-468, 1184-1229, 1270-1271, 1656-1747 or a specific binding fragment thereof, a sequence of amino acids that exhibits at least 95% sequence identity to any of SEQ ID NOS: 81-102, 156-177, 275-468, 1184-1229, 1270-1271, 1656-1747 or a specific binding fragment thereof and that contains the one or more of the amino acid substitutions.

In some embodiments of any one of the variant CD155 polypeptides, the variant CD155 polypeptide specifically binds to the ectodomain of one or more of TIGIT, CD226 or CD96 with increased affinity compared to the unmodified CD155. In some embodiments, the variant CD155 polypeptide specifically binds to the ectodomain of TIGIT or CD226 with increased affinity compared to the unmodified CD155. In some embodiments, the variant CD155 polypeptide specifically binds to the ectodomain of TIGIT and the ectodomain of CD226 each with increased affinity compared to the unmodified CD155. In some embodiments, the variant CD155 polypeptide specifically binds to the ectodomain of one or more of TIGIT, CD226 or CD96 with increased affinity and specifically binds to the ectodomain of one or more of the other of TIGIT, CD226 or CD96 with decreased affinity compared to the unmodified CD155. In some embodiments, the variant CD155 polypeptide specifically binds to the ectodomain of TIGIT with increased affinity and specifically binds to the ectodomain of CD226 with decreased affinity compared to the unmodified CD155. In some embodiments, the variant polypeptide specifically binds to the ectodomain of TIGIT with increased selectivity compared to the unmodified CD155. In some embodiments, the increased selectivity comprises a greater ratio of binding of the variant polypeptide for TIGIT versus CD226 compared to the ratio of binding of the unmodified CD155 polypeptide for TIGIT versus CD226. In some embodiments, the ratio is greater by at least or at least about 1.5-fold, 2.0-fold, 3.0-fold, 4.0-fold, 5.0-fold, 10-fold, 15-fold, 20-fold, 30-fold, 40-fold, 50-fold or more. In some embodiments, the variant CD155 polypeptide specifically binds to the ectodomain of CD226 with increased affinity and specifically binds to the ectodomain of TIGIT with decreased affinity compared to the unmodified CD155.

In some embodiments of any one of the variant CD155 polypeptides, the TIGIT is a human TIGIT. In some embodiments, the CD226 is a human CD226. In some embodiments, the CD96 is a human CD96.

In some embodiments of any one of the variant CD155 polypeptides, the binding activity is altered (increased or decreased) more than 1.2-fold, 1.5-fold, 2-fold, 3-fold, 4-fold, 5-fold, 6-fold, 7-fold, 8-fold, 9-fold, 10-fold, 20-fold, 30-fold 40-fold or 50-fold compared to the unmodified CD155.

In some embodiments of any one of the variant CD155 polypeptides, the variant CD155 polypeptide is a soluble protein.

In some embodiments of any one of the variant CD155 polypeptides, the variant CD155 polypeptide is linked to a multimerization domain. In some embodiments, the multimerization domain is an Fc domain or a variant thereof with reduced effector function.

In some embodiments of any one of the variant CD155 polypeptides, the variant CD155 polypeptide is linked to a moiety that increases biological half-life of the polypeptide. In some embodiments, the variant CD155 polypeptide is linked to an Fc domain or a variant thereof with reduced effector function. In some embodiments, the Fc domain is mammalian, optionally human; or the variant Fc domain comprises one or more amino acid modifications compared to an unmodified Fc domain that is mammalian, optionally human. In some embodiments, the Fc domain or variant thereof comprises the sequence of amino acids set forth in SEQ ID NO: 56 or SEQ ID NO: 57 or a sequence of amino acids that exhibits at least 85% sequence identity to SEQ ID NO: 56 or SEQ ID NO: 57. In some embodiments, the Fc domain comprises one or more amino acid modifications selected from among E233P, L234A, L234V, L235A, L235E, G236del, G237A, S267K, N297G, V302C, and K447del, each by EU numbering. In some embodiments, the Fc domain comprises the amino acid modification C220S by EU numbering. In some embodiments, the variant CD155 polypeptide is linked to the multimerization domain or Fc indirectly via a linker, optionally a G4S linker.

In some embodiments of any one of the variant CD155 polypeptides, the variant CD155 polypeptide is a transmembrane immunomodulatory protein that further comprises a transmembrane domain linked to the extracellular domain (ECD) of specific binding fragment thereof of the variant CD155 polypeptide. In some embodiments, the transmembrane domain comprises the sequence of amino acids set forth as residues 344-367 of SEQ ID NO: 20 or a functional variant thereof that exhibits at least 85% sequence identity to residues 344-367 of SEQ ID NO: 20. In some embodiments, the variant CD155 polypeptide further comprises a cytoplasmic signaling domain linked to the transmembrane domain. In some embodiments, the cytoplasmic signaling domain comprises the sequence of amino acids set forth as residues 368-417 of SEQ ID NO: 20 or a functional variant thereof that exhibits at least 85% sequence identity to residues 368-417 of SEQ ID NO: 20.

In some of any of the provided embodiments, the variant CD155 polypeptide modulates a response of an immune cell, such as a T cell. In some embodiments, the response, e.g. T cell response, is increased or is decreased. In some embodiments of any one of the variant CD155 polypeptides, the variant CD155 increases IFN-gamma (interferon-gamma) expression relative to the unmodified CD155 in an in vitro primary T-cell assay. In some embodiments of any one of the variant CD155 polypeptides described herein, the variant CD155 polypeptide increases T cell signaling relative to the unmodified CD155, such as determined using a reporter assay involving a T cell (e.g. Jurkat) engineered with a reporter (e.g. luciferase) operably connected to an IL-2 promoter. In some embodiments of any one of the variant CD155 polypeptides described herein, the variant CD155 polypeptide decreases T cell signaling relative to the unmodified CD155, such as determined using a reporter assay involving a T cell (e.g. Jurkat) engineered with a reporter (e.g. luciferase) operably connected to an IL-2 promoter. In some of any such embodiments, the variant CD155 polypeptide is provided in any of a variety of formats, such as soluble or immobilized (e.g. plate-bound).

In some embodiments of any one of the variant CD155 polypeptides, the variant CD155 decreases IFN-gamma (interferon-gamma) expression relative to the unmodified CD155 in an in vitro primary T-cell assay. In some embodiments of any one of the variant CD155 polypeptides, the variant CD155 polypeptide is deglycosylated. In some embodiments of any one of the variant CD155 polypeptides described herein, the variant CD155 polypeptide increases T cell signaling relative to the unmodified CD155, such as determined using a reporter assay involving a T cell (e.g. Jurkat) engineered with a reporter (e.g. luciferase) operably connected to an IL-2 promoter. In some embodiments of any one of the variant CD155 polypeptides described herein, the variant CD155 polypeptide decreases T cell signaling relative to the unmodified CD155, such as determined using a reporter assay involving a T cell (e.g. Jurkat) engineered with a reporter (e.g. luciferase) operably connected to an IL-2 promoter. In some of any such embodiments, the variant CD155 polypeptide is provided in any of a variety of formats, such as soluble or immobilized (e.g. plate-bound).

In some embodiments, provided herein is an immunomodulatory polypeptide comprising the variant CD155 according to any one of the provided embodiments and a second polypeptide comprising an immunoglobulin superfamily (IgSF) domain of an second polypeptide comprising an immunoglobulin superfamily (IgSF) domain of an IgSF family member or an affinity-modified IgSF domain thereof, said affinity-modified IgSF domain comprising one or more amino acid modifications compared to the unmodified or wild-type IgSF domain of the IgSF family member. In some cases, the variant CD155 polypeptide and the second polypeptide are linked directly or are linked indirectly via a linker. In some embodiments, the IgSF domain is affinity modified and exhibits altered binding to one or more of its cognate binding partner(s) compared to the unmodified or wild-type IgSF domain of the IgSF family member. In some embodiments, the IgSF domain exhibits increased binding to one or more of its cognate binding partner(s) compared to the unmodified or wild-type IgSF domain. In some embodiments, the variant CD155 polypeptide is a first variant CD155 polypeptide and the IgSF domain of the second polypeptide is an IgSF domain from a second variant CD155 polypeptide according to any one of the embodiments described herein, wherein the first and second variant CD155 polypeptides are the same or different. In some embodiments, the variant CD155 polypeptide is capable of specifically binding to TIGIT or CD226 and the IgSF domain is capable of binding to a cognate binding partner other than one specifically bound by the variant CD155 polypeptide. In some embodiments, the IgSF domain is from a member of the B7 family.

In some embodiments, the IgSF domain binds to a ligand expressed on a tumor or is an inflammatory-localizing moiety that binds to a ligand expressed on a cell or tissue associated with an inflammatory environment. In some embodiments, the ligand is B7H6. In some embodiments, the IgSF domain is from NKp30.

In some embodiments, the IgSF domain of the second polypeptide is an IgSF domain of a ligand that binds to an inhibitory receptor, or is an affinity-modified IgSF domain thereof. In some embodiments, the IgSF domain of the second polypeptide is an affinity-modified IgSF domain and the affinity-modified IgSF domain exhibits increased binding affinity and/or binding selectivity for the inhibitory receptor compared to binding of the unmodified IgSF domain to the inhibitory receptor. In some embodiments, the inhibitory receptor is TIGIT, CD112R, CTLA-4 or PD-1; or the ligand of the inhibitory receptor is CD112, CD80, PD-L1 or PD-L2.

In some embodiments, the second polypeptide is selected from: (i) a variant CD80 polypeptide comprising an IgSF domain of any of SEQ ID NOS set forth in Table 3, optionally any of the SEQ ID NOs: 896-928, 930-968, 970-1002, 1004-1042, 1044-1116; (ii) a variant PD-L1 polypeptide comprising an IgSF domain of any of SEQ ID NOS set forth in Table 4, optionally any of the SEQ ID NOs: 470-664, 1753-1755, 1757-2031; (iii) a variant PD-L2 polypeptide comprising an IgSF of any of SEQ ID NOS set forth in Table 5, optionally any of the SEQ ID NOs: 31, 667-717, 719-725, 727-794, 796-870, 872-895; (iv) a variant CD112 polypeptide comprising an IgSF domain set forth in any of SEQ ID NOS: 1273-1366, 1368-1609, (v) a sequence of amino acids that exhibits at least 90%, 91%, 92%, 93%, 94%, 95%, 95%, 97%, 98%, 99% or more sequence identity to any of the SEQ ID NOS in (i)-(iii) and that comprises the amino acid modifications, optionally amino acid substitutions, insertions and/or deletions; or (vi) a specific binding fragment of any of (i)-(v). In some embodiments, the immunomodulatory protein further contains a third polypeptide containing an IgSF domain of an IgSF family member or an affinity-modified IgSF domain thereof, said affinity-modified IgSF domain containing one or more amino acid modifications compared to the unmodified or wild-type IgSF domain of the IgSF family member. In some aspects, the third polypeptide is the same as the first and/or second polypeptide; or the third polypeptide is different from the first and/or second polypeptide. In some embodiments, the third polypeptide is selected from: (i) a variant CD80 polypeptide comprising an IgSF domain set forth in any of SEQ ID NOS: 896-928, 930-968, 970-1002, 1004-1042, 1044-1116; (ii) a variant PD-L1 polypeptide comprising an IgSF domain set forth in any of SEQ ID NOS: 470-664, 1753-1755, 1757-2031; (iii) a variant PD-L2 polypeptide comprising an IgSF domain set forth in any of SEQ ID NOS: 667-717, 719-725, 727-794, 796-870, 872-895; (iv) a variant CD112 polypeptide comprising an IgSF domain set for in any of SEQ ID NOS: 1273-1366, 1368-1609; (v) a sequence of amino acids that exhibits at least 90%, 91%, 92%, 93%, 94%, 95%, 95%, 97%, 98%, 99% or more sequence identity to any of the SEQ ID NOS in (i)-(iv) and that comprises the amino acid modifications, optionally amino acid substitutions, insertions and/or deletions; or (vi) a specific binding fragment of any of (i)-(v).

In some embodiments, the IgSF domain or affinity-modified IgSF domain thereof, optionally of the second or third polypeptide is or comprises an IgV domain. In some embodiments, the variant CD155 polypeptide is or comprises an IgV domain.

In some of any such embodiments, the immunomodulatory protein further contains at least one additional polypeptide containing an IgSF domain of an IgSF family member or an affinity-modified IgSF domain thereof, said affinity-modified IgSF domain containing one or more amino acid modifications compared to the unmodified or wild-type IgSF domain of the IgSF family member.

In some embodiments according to any one of the immunomodulatory proteins, the immunomodulatory protein is linked to a multimerization domain. In some embodiments, the immunomodulatory protein further comprises a multimerization domain linked to at least one of the variant CD155 polypeptide or the second polypeptide. In some embodiments, the immunomodulatory protein further contains a multimerization domain linked to at least one of the variant CD155 polypeptide, the second polypeptide and/or the third polypeptide. In some embodiments, the multimerization domain is an Fc domain or a variant thereof with reduced effector function. In some embodiments, the immunomodulatory protein is linked to an Fc domain or a variant thereof with reduced effector function. In some embodiments, the Fc domain or variant thereof comprises the sequence of amino acids set forth in SEQ ID NO: 56 or SEQ ID NO: 57 or a sequence of amino acids that exhibits at least 85% sequence identity to SEQ ID NO: 56 or SEQ ID NO: 57. In some embodiments, the multimerization domain promotes heterodimer formation.

Provided herein is an immunomodulatory protein containing a first variant CD155 polypeptide provided herein in which the multimerization domain is a first multimerization domain and a second variant CD155 polypeptide provided in which the multimerization domain is a second multimerization domain, wherein the first and second multimerization domains interact to form a multimer containing the first and second variant CD155 polypeptide. In some embodiments, the multimerization domain is a first multimerization domain and interacts with a second multimerization domain to form a multimer containing the immunomodulatory protein. In some cases, the immunomodulatory protein is a first immunomodulatory protein and a second immunomodulatory protein is linked directly or indirectly via a linker to the second multimerization domain, wherein the multimer comprises the first and second immunomodulatory protein. In some embodiments, the second immunomodulatory protein is an immunomodulatory protein according to any of the embodiments provided.

In some embodiments, the multimer is a dimer. In some cases, the immunomodulatory protein is a homodimer. In some aspects, the immunomodulatory protein is a heterodimer.

In some of any such embodiments, the first and/or second multimerization domain is an Fc domain or a variant thereof with reduced effector function. In some embodiments, the first and second multimerization domain is the same or different.

In some embodiments, provided herein is a conjugate comprising a variant CD155 according to any one of the provided embodiments, or an immunomodulatory protein according to any one of the provided embodiments, linked to a moiety. In some embodiments, the moiety is a targeting moiety that specifically binds to a molecule on the surface of a cell. In some embodiments, the targeting moiety specifically binds to a molecule on the surface of an immune cell. In some embodiments, the immune cell is an antigen presenting cell or a lymphocyte. In some embodiments, the targeting moiety binds to a molecule on the surface of a tumor. In some embodiments, the moiety is a protein, a peptide, nucleic acid, small molecule or nanoparticle. In some embodiments, the moiety is an antibody or antigen-binding fragment. In some embodiments, the conjugate is divalent, tetravalent, hexavalent or octavalent.

In some embodiments, provided herein is a nucleic acid molecule encoding a variant CD155 polypeptide according to any one of the provided embodiments or an immunomodulatory protein according to any one of the provided embodiments. In some embodiments, the nucleic acid molecule is a synthetic nucleic acid. In some embodiments, the nucleic acid is cDNA.

In some embodiments, provided herein is a vector comprising the nucleic acid of any one of the provided embodiments. In some embodiments, the vector is an expression vector. In some embodiments, the vector is a mammalian expression vector or a viral vector.

In some embodiments, provided herein is a cell comprising the vector according to any one of the provided embodiments. In some embodiments, the cell is a mammalian cell. In some embodiments, the cell is a human cell.

In some embodiments, provided herein is a method of producing a variant CD155 polypeptide or an immunomodulatory protein, comprising introducing the nucleic acid molecule according to any one of the provided embodiments or vector according to any one of the provided embodiments into a host cell under conditions to express the protein in the cell. In some embodiments, the method further comprises isolating or purifying the variant CD155 polypeptide or immunomodulatory protein from the cell.

In some embodiments, provided herein is a method of engineering a cell expressing a variant CD155 polypeptide, comprising introducing a nucleic acid molecule encoding the variant CD155 polypeptide or immunomodulatory protein according to any one of the provided embodiments into a host cell under conditions in which the polypeptide is expressed in the cell.

In some embodiments, provided herein are engineered cells. In some embodiments, the engineered cell comprises any of the variant CD155 polypeptide described herein, or any of the immunomodulatory protein described herein, or any of the nucleic acid molecules described herein, or any of the vectors described herein. In some embodiments, the variant CD155 polypeptide or immunomodulatory protein is encoded by a nucleic acid in the engineered cells described herein containing sequence of nucleotides encoding a signal peptide. In some embodiments, the variant CD155 polypeptide or immunomodulatory protein in the engineered cells described herein does not comprise a transmembrane domain and/or is not expressed on the surface of the cell. In some embodiments, the variant CD155 polypeptide or immunomodulatory polypeptide in the engineered cells described herein is secreted from the engineered cell. In some embodiments, the engineered cell comprises a variant CD155 polypeptide that comprises a transmembrane domain and/or comprises any of the transmembrane immunomodulatory protein described herein. In some embodiments, the variant CD155 polypeptide in the engineered cells described herein is expressed on the surface of the cell.

In some embodiments, provided herein is an engineered cell, expressing the variant CD155 polypeptide or immunomodulatory protein according to any one of the provided embodiments described herein. In some embodiments, the engineered cell is an immune cell. In some embodiments, the immune cell is an antigen presenting cell (APC) or a lymphocyte. In some embodiments, the engineering cell is a primary cell. In some embodiments, the engineered cell is a mammalian cell. In some embodiments, the engineered cell is a human cell. In some embodiments, the lymphocyte is a T cell. In some embodiments, the APC is an artificial APC.

In some embodiments, the engineered cell further comprises a chimeric antigen receptor (CAR) or an engineered T-cell receptor (TCR).

Also provided herein are infectious agents. In some embodiments, the provided infectious agents comprise a nucleic acid molecule encoding any of the variant CD155 polypeptide described herein, or any of the immunomodulatory proteins described herein. In some embodiments, the encoded variant CD155 polypeptide or immunomodulatory proteins does not comprise a transmembrane domain and/or is not expressed on the surface of a cell in which it is expressed. In some embodiments, the encoded variant CD155 polypeptide or immunomodulatory polypeptide is secreted from a cell in which it is expressed. In some embodiments, the encoded variant CD155 polypeptide comprises a transmembrane domain. In some embodiments, the encoded variant CD155 polypeptide is expressed on the surface of a cell in which it is expressed.

In some embodiments, the infectious agent is a bacterium or a virus. In some embodiments, the virus is a lentiviral or retroviral construct or a hybrid thereof. In some embodiments, the infectious agent is a virus and the virus is an oncolytic virus. In some embodiments, the oncolytic virus is an adenovirus, adeno-associated virus, herpes virus, Herpes Simplex Virus, Vesticular Stomatic virus, Reovirus, Newcastle Disease virus, parvovirus, measles virus, vesticular stomatitis virus (VSV), Coxsackie virus or a Vaccinia virus. In some embodiments, the virus specifically targets dendritic cells (DCs) and/or is dendritic cell-tropic. In some embodiments, the virus is a lentiviral vector that is pseudo-typed with a modified Sindbis virus envelope product.

In some embodiments, the infectious agents additionally include a nucleic acid molecule encoding a further gene product that results in death of a target cell or that can augment or boost an immune response. In some embodiments, the further gene product is selected from an anticancer agent, an anti-metastatic agent, an antiangiogenic agent, an immunomodulatory molecule, an immune checkpoint inhibitor, an antibody, a cytokine, a growth factor, an antigen, a cytotoxic gene product, a pro-apoptotic gene product, an anti-apoptotic gene product, a cell matrix degradative gene, genes for tissue regeneration or reprogramming human somatic cells to pluripotency.

In some embodiments, provided herein is a pharmaceutical composition, comprising the variant CD155 polypeptide according to any one of the embodiments described herein, an immunomodulatory protein according to any one of the embodiments described herein, a conjugate according to any one of the embodiments described herein, an engineered cell according to any one of the embodiments described herein, or an infectious agent according to any one of the embodiments described herein. In some embodiments, the pharmaceutical composition further comprises a pharmaceutically acceptable excipient. In some embodiments, the pharmaceutical composition is sterile.

In some embodiments, provided herein is an article of manufacture comprising the pharmaceutical composition according to any one of the embodiments described herein in a vial or container. In some embodiments, the vial or container is sealed.

In some embodiments, provided herein is a kit comprising the pharmaceutical composition according to any one of the embodiments described herein and instructions for use. In some embodiments, provided herein is a kit comprising the article of manufacture according to any one of the embodiments described herein and instructions for use.

In some embodiments, provided herein is a method of modulating an immune response, such as increasing or decreasing an immune response, in a subject, comprising administering the pharmaceutical composition according to any one of the embodiments described herein to the subject. In some embodiments, the method comprises administering the engineered cells of any one of the embodiments described herein. In some embodiments, the engineered cells are autologous to the subject. In some embodiments, the engineered cells are allogenic to the subject. In some embodiments, the method further comprises administering to the subject a soluble variant CD155 polypeptide according to any one of the embodiments described herein, an immunomodulatory protein according to any one of the embodiments described herein, or a conjugate according to any one of the embodiments described herein. In some embodiments, the method comprises administering to the subject an infectious agent encoding a variant CD155 polypeptide according to any one of the embodiments described herein.

In some embodiments, modulating the immune response treats a disease or condition in the subject.

In some embodiments, the immune response is increased. Various formats of a variant CD155 polypeptide are contemplated for administration to a subject to increase an immune response, such as antagonist formats of a variant CD155. In some cases, such methods are carried out under conditions in which signaling by the inhibitory receptor TIGIT is blocked or attenuated by the administration. In some embodiments of the methods provided herein, a variant CD155 polypeptide or immunomodulatory protein that is soluble is administered to the subject. In some embodiments of the methods provided herein, the soluble immunomodulatory protein is an immunomodulatory Fc fusion protein. In some embodiments of the methods provided herein, any of the variant CD155 polypeptide described herein, or any of the immunomodulatory protein described herein is administered to the subject. In some embodiments of the methods provided herein, an engineered cell comprising a secretable variant CD155 polypeptide is administered to the subject. In some embodiments, any of the engineered cells described herein is administered to the subject. In some embodiments of the methods provided herein, an infectious agent encoding a variant CD155 polypeptide that is a secretable immunomodulatory protein is administered to the subject, optionally under conditions in which the infectious agent infects a tumor cell or immune cell and the secretable immunomodulatory protein is secreted from the infected cell.

In some embodiments, the disease or condition is a tumor or cancer. In some embodiments, the disease or condition is selected from melanoma, lung cancer, bladder cancer or a hematological malignancy. In some of any of such embodiments, the variant CD155 is administered in a format that increases an immune response in the subject.

In some embodiments, the immune response is decreased. Various formats of a variant CD155 polypeptide are contemplated for administration to a subject to decrease an immune response, such as agonist formats of a variant CD155. In some cases, such methods are carried out under conditions in which signaling by the inhibitory receptor TIGIT is activated or stimulated or induced by the administration. In some embodiments of the methods provided herein, an immunomodulatory protein or conjugate comprising a variant CD155 polypeptide linked to a moiety that localizes to a cell or tissue of an inflammatory environment is administered to the subject. In some embodiments, the binding molecule comprises an antibody or an antigen-binding fragment thereof or comprises a second polypeptide comprising a wild-type IgSF domain or variant thereof. In some embodiments of the methods provided herein, any of the immunomodulatory proteins described herein or the conjugates described herein is administered to the subject. In some embodiments of the methods provided herein, a variant CD155 polypeptide that is a transmembrane immuno-modulatory protein is administered to the subject. In some embodiments of the methods provided herein, any of the engineered cells comprising a variant CD155 polypeptide that is a transmembrane immunomodulatory protein described herein is administered to the subject. In some embodiments of the methods provided herein, an infectious agent encoding a variant CD155 polypeptide that is a transmembrane immunomodulatory protein is administered to the subject, optionally under conditions in which the infectious agent infects a cell in the subject and the trans-membrane immunomodulatory protein is expressed on the surface of the infected cell.

In some embodiments, the disease or condition is an inflammatory or autoimmune disease or condition. In some embodiments, the disease or condition is an antineutrophil cytoplasmic antibodies (ANCA)-associated vasculitis, a vasculitis, an autoimmune skin disease, transplantation, a Rheumatic disease, an inflammatory gastrointestinal dis-ease, an inflammatory eye disease, an inflammatory neuro-logical disease, an inflammatory pulmonary disease, an inflammatory endocrine disease, or an autoimmune hema-tological disease. In some embodiments, the disease or condition is selected from interstitial bowel disease, trans-plant, Crohn's disease, ulcerative colitis, multiple sclerosis, asthma, rheumatoid arthritis, or psoriasis. In some of any such embodiments, the variant CD155 is administered in a format that decreases an immune response in the subject.

BRIEF DESCRIPTION OF THE DRAWINGS

FIGS. 1A-1C depict various formats of the provided variant IgSF domain molecules. FIG. 1A depicts soluble molecules, including: (1) a variant IgSF domain (vIgD) fused to an Fc chain; (2) a stack molecule containing a first variant IgSF domain (first vIgD) and a second IgSF domain, such as a second variant IgSF domain (second vIgD); (3) a tumor targeting IgSF molecule containing a first variant IgSF domain (vIgD) and an IgSF domain that targets to a tumor antigen, such as an NKp30 IgSF domain; and (4) a variant IgSF domain (vIgD) linked to an antibody (V-mAb). FIG. 1B depicts a transmembrane immunomodulatory pro-tein (TIP) containing a variant IgSF domain (vIgD) expressed on the surface of a cell. In an exemplary embodi-ment, the cognate binding partner of the transmembrane bound vIgD is an inhibitory receptor (e.g. TIGIT), and the TIP containing the vIgD (e.g. CD155 vIgD) antagonizes or blocks the negative signaling of the inhibitory receptor, thereby resulting in an activated T cell or effector T cell. In some cases, if clustering of the inhibitory receptor (TIGIT) is proximal to an activating receptor (e.g. CD226) then agonizing activity by the TIP may be realized. FIG. 1C depicts a secreted immunomodulatory protein (SIP) in which a variant IgSF domain (vIgD) is secreted from a cell, such as a first T cell (e.g. CAR T cell). In an exemplary embodiment, the cognate binding partner of the secreted vIgD is an inhibitory receptor (e.g., TIGIT), which can be expressed by the first cell (e.g., T cell, such as a CAR T cell) and/or on a second cell (e.g. T cell; either endogenous or engineered, such as a CAR T cell). Upon binding of the SIP with its cognate binding partner, the SIP antagonizes or blocks the negative signaling via the inhibitory receptor, thereby resulting in an activated T cell or effector T cell. In all cases, the vIgD can be a V-domain (IgV) only, the combination of the V-domain (IgV) and C-domain (IgC), including the entire extracellular domain (ECD), or any combination of Ig domains of the IgSF superfamily member.

FIG. 5B depicts various exemplary configurations of a stack molecule containing a first variant IgSF domain (first vIgD), a second IgSF domain, such as a second variant IgSF domain (second vIgD), and a third IgSF domain, such as a third variant IgSF domain (third vIgD). As shown, the first vIgD, second IgSF, and third IgSF domains are indepen-dently linked, directly or indirectly, to the N- or C-terminus of an Fc region. For generating a homodimeric Fc molecule, the Fc region is one that is capable of forming a homodimer with a matched Fc region by co-expression of the individual Fc regions in a cell.

Figure 6:
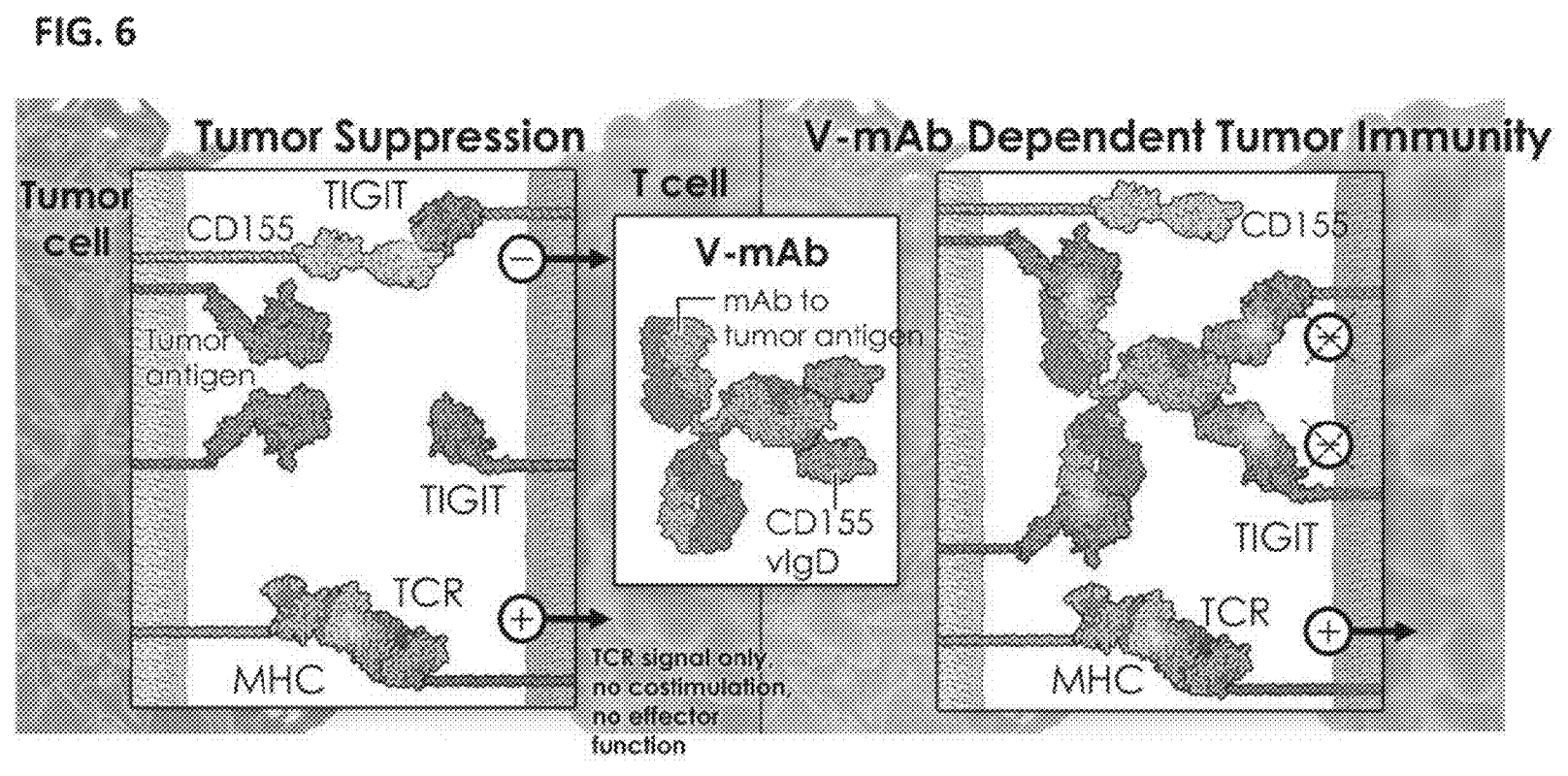

FIG. 6 depicts an exemplary schematic of the activity of a variant IgSF domain (vIgD)-conjugated to an antibody (V-Mab) in which the antibody (e.g. anti-HER2 antibody) binds to an antigen on the surface of the tumor cell to localize the vIgD to the cell. As shown, binding of the antibody to the surface of the tumor cell localizes the vIgD on the tumor cell surface where it can interact with one or more of its cognate binding partners expressed on the surface of an adjacent immune cell (e.g. T cell) to agonize or antagonize receptor signaling. In an exemplary embodiment as shown, the variant IgSF domain (vIgD) is a variant of an IgSF domain of CD155 that binds, such as has increased affinity for, the inhibitory receptor TIGIT. Binding of the CD155 vIgD to the TIGIT inhibitory receptor antagonizes or blocks the negative signaling of the inhibitory receptor, thereby resulting in an activated T cell or effector T cell. In some cases, if clustering of the inhibitory receptor (TIGIT) is proximal to an activating receptor (e.g. CD226) then agonizing of the inhibitory receptor activity by the TIP may be realized.

FIG. 7A shows various configurations in which a variant IgSF domain is linked, directly or indirectly, to the N- and/or C-terminus of the light chain of an antibody. FIG. 7B shows various configurations in which a variant IgSF domain is linked, directly or indirectly, to the N- and/or C-terminus of the heavy chain of an antibody. FIG. 7C depicts the results V-Mab configurations when a light chain of FIG. 7A and a heavy chain of FIG. 7B are co-expressed in a cell.

DETAILED DESCRIPTION

Figure 1A:
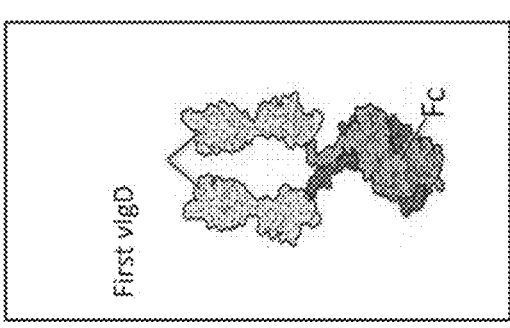
Figure 1A:
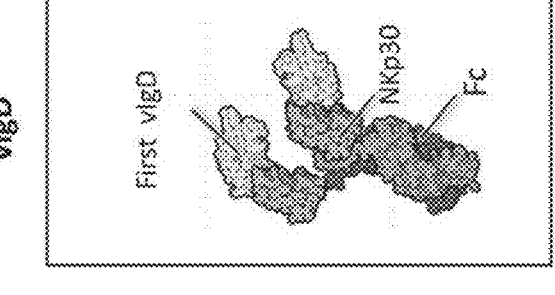
Figure 1A:
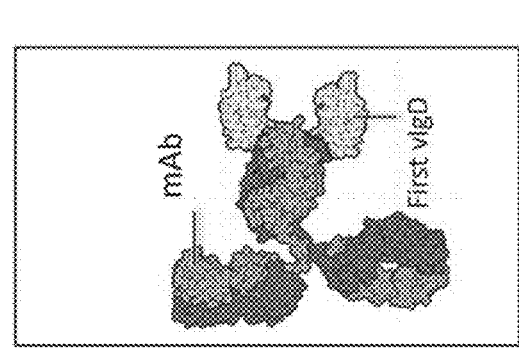

Provided herein are immunomodulatory proteins that are or comprise variants or mutants of CD155 (also known as Poliovirus receptor or PVR) or specific binding fragments thereof that exhibit activity to bind to at least one target ligand cognate binding partner (also called counter-structure protein). In some embodiments, the variant CD155 polypeptides contain one or more amino acid modifications (e.g. amino acid substitutions, deletions or additions) compared to an unmodified or wild-type CD155 polypeptide. In some embodiments, the one or more amino acid modifications (e.g. substitutions) are in an IgSF domain (e.g. IgV) of an unmodified or wild-type CD155 polypeptide. In some embodiments, the variant CD155 polypeptide and immunomodulatory proteins exhibits altered, such as increased or decreased, binding activity or affinity for at least one cognate binding partner, such as at least one of TIGIT, CD226, or CD96. In some embodiments, the immunomodulatory proteins are soluble. In some embodiments, the immunomodulatory proteins are transmembrane immunomodulatory proteins capable of being expressed on the surface of cells. In some embodiments, also provided herein are one or more other immunomodulatory proteins that are conjugates or fusions containing a variant CD155 polypeptide provided herein and one or more other moiety or polypeptide.

In some embodiments, the variant CD155 polypeptides and immunomodulatory proteins modulate an immunological immune response, such an increase or decrease an immune response. In some embodiments, the variant CD155 polypeptides and immunomodulatory proteins provided herein can be used for the treatment of diseases or conditions that are associated with a dysregulated immune response.

In some embodiments, the provided variant CD155 polypeptides modulate T cell activation via interactions with costimulatory and/or coinhibitory signaling molecules. In general, antigen specific T-cell activation generally requires two distinct signals. The first signal is provided by the interaction of the T-cell receptor (TCR) with major histocompatibility complex (MHC) associated antigens present on antigen presenting cells (APCs). The second signal is costimulatory to TCR engagement and is necessary for T cell proliferation, differentiation and/or survival, including, in some cases, to avoid T-cell apoptosis or anergy.

In some embodiments, under normal physiological conditions, the T cell-mediated immune response is initiated by antigen recognition by the T cell receptor (TCR) and is regulated by a balance of co-stimulatory and inhibitory signals (e.g., immune checkpoint proteins). The immune system relies on immune checkpoints to prevent autoimmunity (i.e., self-tolerance) and to protect tissues from excessive damage during an immune response, for example during an attack against a pathogenic infection. In some cases, however, these immunomodulatory proteins can be dysregulated in diseases and conditions, including tumors, as a mechanism for evading the immune system.

In some embodiments, among known T-cell costimulatory receptors is CD226, which is the T-cell costimulatory receptor for the ligands CD155 (also known as the poliovirus receptor, PVR) and CD112 (also known as Nectin-2). CD155 and CD112 are normally expressed on the surface of APCs (e.g. dendritic cells) and, in some cases, are overexpressed in tumors. Binding of CD155 or CD112 ligands by CD226, and engagement of CD226, enhances immune responses. In some aspects, CD226 is expressed on NK cells and T cells, including CD4+ and CD8+ T cells, whereby engagement of CD226 can promote Th1 differentiation and/or NK cell activation. However, CD155 and CD112 ligands can also bind to the inhibitory T-cell receptor TIGIT (T cell immunoreceptor with Ig and ITIM domains) to inhibit or down-modulate immune responses. TIGIT, which also can be expressed on NK cells and T cells, can suppress or inhibit the cytolytic activity of NK cells, T cell proliferation and/or proinflammatory cytokine production. In some embodiments, the receptor CD96, which binds the ligand CD155 but not CD112, also can exhibit an opposing effect to CD226 to suppress NK cell activity. Thus, CD226 and TIGIT or CD96 may play opposing roles in immune responses to modulate pro-inflammatory or anti-inflammatory response which, in some cases, are associated with a number of diseases and conditions.

In some embodiments, enhancement or suppression of the activity of CD226, TIGIT and/or CD96 receptors has clinical significance for treatment of inflammatory and autoimmune disorders, cancer, and viral infections. In some cases, however, therapies to intervene and alter the immunomodulatory effects of such receptors are constrained by the spatial orientation requirements as well as size limitations imposed by the confines of the immunological synapse. In some aspects, existing therapeutic drugs, including antibody drugs, may not be able to interact simultaneously with the multiple target proteins involved in modulating these interactions. In addition, in some cases, existing therapeutic drugs may only have the ability to antagonize but not agonize an immune response. Additionally, pharmacokinetic differences between drugs that independently target one of these receptors can create difficulties in properly maintaining a desired blood concentration of such drug combinations throughout the course of treatment.

In some embodiments, the provided variant CD155 polypeptides or immunomodulatory proteins modulate (e.g. increase or decrease) immunological activity induced or associated with one or more of the costimulatory receptor TIGIT, CD226, and CD96. Thus, in some embodiments, the provided polypeptides overcome these constraints by providing variant CD155 with altered (e.g. increased or decreased) binding affinities to TIGIT, CD226 and/or CD96, thereby agonizing or antagonizing the complementary effects of costimulation by receptors. Methods of making and using these variant CD155 are also provided.

All publications, including patents, patent applications scientific articles and databases, mentioned in this specification are herein incorporated by reference in their entirety for all purposes to the same extent as if each individual publication, including patent, patent application, scientific article or database, were specifically and individually indicated to be incorporated by reference. If a definition set forth herein is contrary to or otherwise inconsistent with a definition set forth in the patents, applications, published applications and other publications that are herein incorporated by reference, the definition set forth herein prevails over the definition that is incorporated herein by reference.

The section headings used herein are for organizational purposes only and are not to be construed as limiting the subject matter described.

I. Definitions

Unless defined otherwise, all terms of art, notations and other technical and scientific terms or terminology used herein are intended to have the same meaning as is commonly understood by one of ordinary skill in the art to which the claimed subject matter pertains. In some cases, terms with commonly understood meanings are defined herein for clarity and/or for ready reference, and the inclusion of such definitions herein should not necessarily be construed to represent a substantial difference over what is generally understood in the art.

The terms used throughout this specification are defined as follows unless otherwise limited in specific instances. As used in the specification and the appended claims, the singular forms "a," "an," and "the" include plural referents unless the context clearly dictates otherwise. Unless defined otherwise, all technical and scientific terms, acronyms, and abbreviations used herein have the same meaning as commonly understood by one of ordinary skill in the art to which the invention pertains. Unless indicated otherwise, abbreviations and symbols for chemical and biochemical names is per IUPAC-IUB nomenclature. Unless indicated otherwise, all numerical ranges are inclusive of the values defining the range as well as all integer values in-between.

The term "affinity modified" as used in the context of an immunoglobulin superfamily domain, means a mammalian immunoglobulin superfamily (IgSF) domain having an altered amino acid sequence (relative to the corresponding wild-type parental or unmodified IgSF domain) such that it has an increased or decreased binding affinity or avidity to at least one of its cognate binding partners (alternatively "counter-structures") compared to the parental wild-type or unmodified (i.e., non-affinity modified) IgSF control domain. Included in this context is an affinity modified CD155 IgSF domain. In some embodiments, the affinity-modified IgSF domain can contain 1, 2, 3, 4, 5, 6, 7, 8, 9, 10, 11, 12, 13, 14, 15, 16, 17, 18, 19, 20, 21, 22, 23, 24, 25, 26, 27, 28, 29, 30 or more amino acid differences, such as amino acid substitutions, in a wildtype or unmodified IgSF domain. An increase or decrease in binding affinity or avidity can be determined using well known binding assays such as flow cytometry. Larsen et al., American Journal of Transplantation, Vol 5: 443-453 (2005). See also, Linsley et al., Immunity, Vol 1: 793-801 (1994). An increase in a protein's binding affinity or avidity to its cognate binding partner(s) is to a value at least 10% greater than that of the wild-type IgSF domain control and in some embodiments, at least 20%, 30%, 40%, 50%, 100%, 200%, 300%, 500%, 1000%, 5000%, or 10000% greater than that of the wild-type IgSF domain control value. A decrease in a protein's binding affinity or avidity to at least one of its cognate binding partner is to a value no greater than 90% of the control but no less than 10% of the wild-type IgSF domain control value, and in some embodiments no greater than 80%, 70% 60%, 50%, 40%, 30%, or 20% but no less than 10% of the wild-type IgSF domain control value. An affinity-modified protein is altered in primary amino acid sequence by substitution, addition, or deletion of amino acid residues. The term "affinity modified IgSF domain" is not to be construed as imposing any condition for any particular starting composition or method by which the affinity-modified IgSF domain was created. Thus, the affinity modified IgSF domains of the present invention are not limited to wild type IgSF domains that are then transformed to an affinity modified IgSF domain by any particular process of affinity modification. An affinity modified IgSF domain polypeptide can, for example, be generated starting from wild type mammalian IgSF domain sequence information, then modeled in silico for binding to its cognate binding partner, and finally recombinantly or chemically synthesized to yield the affinity modified IgSF domain composition of matter. In but one alternative example, an affinity modified IgSF domain can be created by site-directed mutagenesis of a wild-type IgSF domain. Thus, affinity modified IgSF domain denotes a product and not necessarily a product produced by any given process. A variety of techniques including recombinant methods, chemical synthesis, or combinations thereof, may be employed.

The term "allogeneic" as used herein means a cell or tissue that is removed from one organism and then infused or adoptively transferred into a genetically dissimilar organism of the same species. In some embodiments of the invention, the species is murine or human.

The term "autologous" as used herein means a cell or tissue that is removed from the same organism to which it is later infused or adoptively transferred. An autologous cell or tissue can be altered by, for example, recombinant DNA methodologies, such that it is no longer genetically identical to the native cell or native tissue which is removed from the organism. For example, a native autologous T-cell can be genetically engineered by recombinant DNA techniques to become an autologous engineered cell expressing a transmembrane immunomodulatory protein and/or chimeric antigen receptor (CAR), which in some cases involves engineering a T-cell or TIL (tumor infiltrating lymphocyte). The engineered cells are then infused into a patient from which the native T-cell was isolated. In some embodiments, the organism is human or murine.

The terms "binding affinity," and "binding avidity" as used herein means the specific binding affinity and specific binding avidity, respectively, of a protein for its counterstructure under specific binding conditions. In biochemical kinetics avidity refers to the accumulated strength of multiple affinities of individual non-covalent binding interactions, such as between CD155 and its counter-structures TIGIT, CD226, and/or CD96. As such, avidity is distinct from affinity, which describes the strength of a single interaction. An increase or attenuation in binding affinity of a variant CD155 containing an affinity modified CD155 IgSF domain to its counter-structure is determined relative to the binding affinity of the unmodified CD155, such as an unmodified CD155 containing the native or wild-type IgSF domain, such as IgV domain. Methods for determining binding affinity or avidity are known in art. See, for example, Larsen et al., American Journal of Transplantation, Vol 5: 443-453 (2005). In some embodiments, a variant CD155 of the invention (i.e. a CD155 protein containing an affinity modified IgSF domain) specifically binds to TIGIT, CD226, and/or CD96 measured by flow cytometry with a binding affinity that yields a Mean Fluorescence Intensity (MFI) value at least 10%, 20%, 30%, 40%, 50%, 60%, 70%, 80%, 90%, or 100% greater than a wild-type CD155 control in a binding assay.

The term "biological half-life" refers to the amount of time it takes for a substance, such as an immunomodulatory polypeptide comprising a variant CD155 of the present invention, to lose half of its pharmacologic or physiologic activity or concentration. Biological half-life can be affected by elimination, excretion, degradation (e.g., enzymatic) of the substance, or absorption and concentration in certain organs or tissues of the body. In some embodiments, biological half-life can be assessed by determining the time it takes for the blood plasma concentration of the substance to reach half its steady state level ("plasma half-life"). Conjugates that can be used to derivatize and increase the biological half-life of polypeptides of the invention are known in the art and include, but are not limited to, polyethylene glycol (PEG), hydroxyethyl starch (HES), XTEN (extended recombinant peptides; see, WO2013130683), human serum albumin (HSA), bovine serum albumin (BSA), lipids (acylation), and poly-Pro-Ala-Ser (PAS), polyglutamic acid (glutamylation).

The term "chimeric antigen receptor" or "CAR" as used herein refers to an artificial (i.e., man-made) transmembrane protein expressed on a mammalian cell comprising at least an ectodomain, a transmembrane, and an endodomain. Optionally, the CAR protein includes a "spacer" which covalently links the ectodomain to the transmembrane domain. A spacer is often a polypeptide linking the ectodomain to the transmembrane domain via peptide bonds. The CAR is typically expressed on a mammalian lymphocyte. In some embodiments, the CAR is expressed on a mammalian cell such as a T-cell or a tumor infiltrating lymphocyte (TIL). A CAR expressed on a T-cell is referred to herein as a "CAR T-cell" or "CAR-T." In some embodiments the CAR-T is a T helper cell, a cytotoxic T-cell, a natural killer T-cell, a memory T-cell, a regulatory T-cell, or a gamma delta T-cell. When used clinically in, e.g. adoptive cell transfer, a CAR-T with antigen binding specificity to the patient's tumor is typically engineered to express on a T-cell obtained from the patient. The engineered T-cell expressing the CAR is then infused back into the patient. The CAR-T is thus often an autologous CAR-T although allogeneic CAR-T are included within the scope of the invention. The ectodomain of a CAR comprises an antigen binding region, such as an antibody or antigen binding fragment thereof (e.g. scFv), that specifically binds under physiological conditions with a target antigen, such as a tumor specific antigen. Upon specific binding a biochemical chain of events (i.e., signal transduction) results in modulation of the immunological activity of the CAR-T. Thus, for example, upon specific binding by the antigen binding region of the CAR-T to its target antigen can lead to changes in the immunological activity of the T-cell activity as reflected by changes in cytotoxicity, proliferation or cytokine production. Signal transduction upon CAR-T activation is achieved in some embodiments by the CD3-zeta chain ("CD3-z") which is involved in signal transduction in native mammalian T-cells. CAR-Ts can further comprises multiple signaling domains such as CD28, 41BB or OX40, to further modulate immunomodulatory response of the T-cell. CD3-z comprises a conserved motif known as an immunoreceptor tyrosine-based activation motif (ITAM) which is involved in T-cell receptor signal transduction.

The term "collectively" or "collective" when used in reference to cytokine production induced by the presence of two or more variant CD155 of the invention in an in vitro assay, means the overall cytokine expression level irrespective of the cytokine production induced by individual variant CD155. In some embodiments, the cytokine being assayed is IFN-gamma, such as in an in vitro primary T-cell assay.

The term "cognate binding partner" (used interchangeably with "counter-structure") in reference to a polypeptide, such as in reference to an IgSF domain of a variant CD155, refers to at least one molecule (typically a native mammalian protein) to which the referenced polypeptide specifically binds under specific binding conditions. In some aspects, a variant CD155 containing an affinity modified IgSF domain specifically binds to the counter-structure of the corresponding native or wildtype CD155 but with increased or attenuated affinity. A species of ligand recognized and specifically binding to its cognate receptor under specific binding conditions is an example of a counter-structure or cognate binding partner of that receptor. A "cognate cell surface binding partner" is a cognate binding partner expressed on a mammalian cell surface. A "cell surface molecular species" is a cognate binding partner of ligands of the immunological synapse (IS), expressed on and by cells, such as mammalian cells, forming the immunological synapse.

As used herein, "conjugate," "conjugation" or grammatical variations thereof refers the joining or linking together of two or more compounds resulting in the formation of another compound, by any joining or linking methods known in the art. It can also refer to a compound which is generated by the joining or linking together two or more compounds. For example, a variant CD155 polypeptide linked directly or indirectly to one or more chemical moieties or polypeptide is an exemplary conjugate. Such conjugates include fusion proteins, those produced by chemical conjugates and those produced by any other methods.

The term "competitive binding" as used herein means that a protein is capable of specifically binding to at least two cognate binding partners but that specific binding of one cognate binding partner inhibits, such as prevents or precludes, simultaneous binding of the second cognate binding partner. Thus, in some cases, it is not possible for a protein to bind the two cognate binding partners at the same time. Generally, competitive binders contain the same or overlapping binding site for specific binding but this is not a requirement. In some embodiments, competitive binding causes a measurable inhibition (partial or complete) of specific binding of a protein to one of its cognate binding partner due to specific binding of a second cognate binding partner. A variety of methods are known to quantify competitive binding such as ELISA (enzyme linked immunosorbent assay) assays.

The term "conservative amino acid substitution" as used herein means an amino acid substitution in which an amino acid residue is substituted by another amino acid residue having a side chain R group with similar chemical properties (e.g., charge or hydrophobicity). Examples of groups of amino acids that have side chains with similar chemical properties include 1) aliphatic side chains: glycine, alanine, valine, leucine, and isoleucine; 2) aliphatic-hydroxyl side chains: serine and threonine; 3) amide-containing side chains: asparagine and glutamine; 4) aromatic side chains: phenylalanine, tyrosine, and tryptophan; 5) basic side chains: lysine, arginine, and histidine; 6) acidic side chains: aspartic acid and glutamic acid; and 7) sulfur-containing side chains: cysteine and methionine. Conservative amino acids substitution groups are: valine-leucine-isoleucine, phenylalanine-tyrosine, lysine-arginine, alanine-valine, glutamate-aspartate, and asparagine-glutamine.

The term, "corresponding to" with reference to positions of a protein, such as recitation that nucleotides or amino acid positions "correspond to" nucleotides or amino acid positions in a disclosed sequence, such as set forth in the Sequence listing, refers to nucleotides or amino acid positions identified upon alignment with the disclosed sequence based on structural sequence alignment or using a standard alignment algorithm, such as the GAP algorithm. For example, corresponding residues can be determined by alignment of a reference sequence with the sequence of wild-type CD155 set forth in SEQ ID NO:47 (ECD domain) or set forth in SEQ ID NO: 58 or 155 (IgV domain) by structural alignment methods as described herein. By aligning the sequences, one skilled in the art can identify corresponding residues, for example, using conserved and identical amino acid residues as guides.

The terms "decrease" or "attenuate" "or suppress" as used herein means to decrease by a statistically significant amount. A decrease can be at least 10%, 20%, 30%, 40%, 50%, 60%, 70%, 80%, 90%, or 100%.

The terms "derivatives" or "derivatized" refer to modification of a protein by covalently linking it, directly or indirectly, to a composition so as to alter such characteristics as biological half-life, bioavailability, immunogenicity, solubility, toxicity, potency, or efficacy while retaining or enhancing its therapeutic benefit. Derivatives of immunomodulatory polypeptides of the invention are within the scope of the invention and can be made by, for example, glycosylation, pegylation, lipidation, or Fc-fusion.

As used herein, "domain" (typically a sequence of three or more, generally 5 or 7 or more amino acids, such as 10 to 200 amino acid residues) refers to a portion of a molecule, such as a protein or encoding nucleic acid that is structurally and/or functionally distinct from other portions of the molecule and is identifiable. For example, domains include those portions of a polypeptide chain that can form an independently folded structure within a protein made up of one or more structural motifs and/or that is recognized by virtue of a functional activity, such as binding activity. A protein can have one, or more than one, distinct domains. For example, a domain can be identified, defined or distinguished by homology of the primary sequence or structure to related family members, such as homology to motifs. In another example, a domain can be distinguished by its function, such as an ability to interact with a biomolecule, such as a cognate binding partner. A domain independently can exhibit a biological function or activity such that the domain independently or fused to another molecule can perform an activity, such as, for example binding. A domain can be a linear sequence of amino acids or a non-linear sequence of amino acids. Many polypeptides contain a plurality of domains. Such domains are known, and can be identified by those of skill in the art. For exemplification herein, definitions are provided, but it is understood that it is well within the skill in the art to recognize particular domains by name. If needed appropriate software can be employed to identify domains.

The term "ectodomain" as used herein refers to the region of a membrane protein, such as a transmembrane protein, that lies outside the vesicular membrane. Ectodomains often comprise binding domains that specifically bind to ligands or cell surface receptors, such as via a binding domain that specifically binds to the ligand or cell surface receptor. The ectodomain of a cellular transmembrane protein is alternately referred to as an extracellular domain.

The terms "effective amount" or "therapeutically effective amount" refer to a quantity and/or concentration of a therapeutic composition of the invention, including a protein composition or cell composition, that when administered ex vivo (by contact with a cell from a patient) or in vivo (by administration into a patient) either alone (i.e., as a monotherapy) or in combination with additional therapeutic agents, yields a statistically significant decrease in disease progression as, for example, by ameliorating or eliminating symptoms and/or the cause of the disease. An effective amount may be an amount that relieves, lessens, or alleviates at least one symptom or biological response or effect associated with a disease or disorder, prevents progression of the disease or disorder, or improves physical functioning of the patient. In the case of cell therapy, the effective amount is an effective dose or number of cells administered to a patient by adoptive cell therapy. In some embodiments the patient is a mammal such as a non-human primate or human patient.

The term "endodomain" as used herein refers to the region found in some membrane proteins, such as transmembrane proteins, that extends into the interior space defined by the cell surface membrane. In mammalian cells, the endodomain is the cytoplasmic region of the membrane protein. In cells, the endodomain interacts with intracellular constituents and can be play a role in signal transduction and thus, in some cases, can be an intracellular signaling domain. The endodomain of a cellular transmembrane protein is alternately referred to as a cytoplasmic domain, which, in some cases, can be a cytoplasmic signaling domain.

The terms "enhanced" or "increased" as used herein in the context of increasing immunological activity of a mammalian lymphocyte means to increase one or more activities the lymphocyte. An increased activity can be one or more of increase cell survival, cell proliferation, cytokine production, or T-cell cytotoxicity, such as by a statistically significant amount. In some embodiments, reference to increased immunological activity means to increase interferon gamma (IFN-gamma) production, such as by a statistically significant amount. In some embodiments, the immunological activity can be assessed in a mixed lymphocyte reaction (MLR) assay. Methods of conducting MLR assays are known in the art. Wang et al., Cancer Immunol Res. 2014 September: 2(9):846-56. Other methods of assessing activities of lymphocytes are known in the art, including any assay as described herein. In some embodiments an enhancement can be an increase of at least 10%, 20%, 30%, 40%, 50%, 75%, 100%, 200%, 300%, 400%, or 500% greater than a non-zero control value.

The term "engineered cell" as used herein refers to a mammalian cell that has been genetically modified by human intervention such as by recombinant DNA methods or viral transduction. In some embodiments, the cell is an immune cell, such as a lymphocyte (e.g. T cell, B cell, NK cell) or an antigen presenting cell (e.g. dendritic cell). The cell can be a primary cell from a patient or can be a cell line. In some embodiments, an engineered cell of the invention comprises a variant CD155 of the invention engineered to modulate immunological activity of a T-cell expressing TIGIT, CD226, and/or CD96 to which the variant CD155 specifically binds. In some embodiments, the variant CD155 is a transmembrane immunomodulatory protein (hereinafter referred to as "TIP") containing the extracellular domain or a portion thereof containing the IgV domain linked to a transmembrane domain (e.g. a CD155 transmembrane domain) and, optionally, an intracellular signaling domain. In some cases, the TIP is formatted as a chimeric receptor containing a heterologous cytoplasmic signaling domain or endodomain. In some embodiments, an engineered cell is capable of expressing and secreting an immunomodulatory protein as described herein. Among provided engineered cells also are cells further containing an engineered T-cell receptor (TCR) or chimeric antigen receptor (CAR).

The term "engineered T-cell" as used herein refers to a T-cell such as a T helper cell, cytotoxic T-cell (alternatively, cytotoxic T lymphocyte or CTL), natural killer T-cell, regulatory T-cell, memory T-cell, or gamma delta T-cell, that has been genetically modified by human intervention such as by recombinant DNA methods or viral transduction methods. An engineered T-cell comprises a variant CD155 transmembrane immunomodulatory protein (TIP) or secreted immunodulatory protein (SIP) of the present invention that is expressed on the T-cell and is engineered to modulate immunological activity of the engineered T-cell itself, or a mammalian cell to which the variant CD155 expressed on the T-cell specifically binds.

The term "engineered T-cell receptor" or "engineered TCR" refers to a T-cell receptor (TCR) engineered to specifically bind with a desired affinity to a major histocompatibility complex (MHC)/peptide target antigen that is selected, cloned, and/or subsequently introduced into a population of T-cells, often used for adoptive immunotherapy. In contrast to engineered TCRs, CARs are engineered to bind target antigens in a MHC independent manner.

The term "expressed on" as used herein is used in reference to a protein expressed on the surface of a cell, such as a mammalian cell. Thus, the protein is expressed as a membrane protein. In some embodiments, the expressed protein is a transmembrane protein. In some embodiments, the protein is conjugated to a small molecule moiety such as a drug or detectable label. Proteins expressed on the surface of a cell can include cell-surface proteins such as cell surface receptors that are expressed on mammalian cells.

The term "half-life extending moiety" refers to a moiety of a polypeptide fusion or chemical conjugate that extends the half-life of a protein circulating in mammalian blood serum compared to the half-life of the protein that is not so conjugated to the moiety. In some embodiments, half-life is extended by greater than or greater than about 1.2-fold, 1.5-fold, 2.0-fold, 3.0-fold, 4.0-fold, 5.0-fold, or 6.0-fold. In some embodiments, half-life is extended by more than 6 hours, more than 12 hours, more than 24 hours, more than 48 hours, more than 72 hours, more than 96 hours or more than 1 week after in vivo administration compared to the protein without the half-life extending moiety. The half-life refers to the amount of time it takes for the protein to lose half of its concentration, amount, or activity. Half-life can be determined for example, by using an ELISA assay or an activity assay. Exemplary half-life extending moieties include an Fc domain, a multimerization domain, polyethylene glycol (PEG), hydroxyethyl starch (HES), XTEN (extended recombinant peptides; see, WO2013130683), human serum albumin (HSA), bovine serum albumin (BSA), lipids (acylation), and poly-Pro-Ala-Ser (PAS), and polyglutamic acid (glutamylation).

The term "immunological synapse" or "immune synapse" as used herein means the interface between a mammalian cell that expresses MHC I (major histocompatibility complex) or MHC II, such as an antigen-presenting cell or tumor cell, and a mammalian lymphocyte such as an effector T cell or Natural Killer (NK) cell.

An Fc (fragment crystallizable) region or domain of an immunoglobulin molecule (also termed an Fc polypeptide) corresponds largely to the constant region of the immunoglobulin heavy chain, and is responsible for various functions, including the antibody's effector function(s). The Fc domain contains part or all of a hinge domain of an immunoglobulin molecule plus a CH2 and a CH3 domain. The Fc domain can form a dimer of two polypeptide chains joined by one or more disulfide bonds. In some embodiments, the Fc is a variant Fc that exhibits reduced (e.g. reduced greater than 30%, 40%, 50%, 60%, 70%, 80%, 90% or more) activity to facilitate an effector function. In some embodiments, reference to amino acid substitutions in an Fc region is by EU numbering system unless described with reference to a specific SEQ ID NO. EU numbering is known and is according to the most recently updated IMGT Scientific Chart (IMGT®, the international ImMunoGeneTics information System®, http://www.imgt.org/IMGTScientific-Chart/Numbering/Hu_IGHGnber.html (created: 17 May 2001, last updated: 10 Jan. 2013) and the EU index as reported in Kabat, E. A. et al. Sequences of Proteins of Immunological interest. 5th ed. US Department of Health and Human Services, NIH publication No. 91-3242 (1991).

An immunoglobulin Fc fusion ("Fc-fusion"), such as an immunomodulatory Fc fusion protein, is a molecule comprising one or more polypeptides (or one or more small molecules) operably linked to an Fc region of an immunoglobulin. An Fc-fusion may comprise, for example, the Fc region of an antibody (which facilitates effector functions and pharmacokinetics) and a variant CD155. An immunoglobulin Fc region may be linked indirectly or directly to one or more variant CD155 or small molecules (fusion partners). Various linkers are known in the art and can optionally be used to link an Fc to a fusion partner to generate an Fc-fusion. Fc-fusions of identical species can be dimerized to form Fc-fusion homodimers, or using non-identical species to form Fc-fusion heterodimers. In some embodiments, the Fc is a mammalian Fc such as a murine or human Fc.

The term "host cell" refers to a cell that can be used to express a protein encoded by a recombinant expression vector. A host cell can be a prokaryote, for example, E. coli, or it can be a eukaryote, for example, a single-celled eukaryote (e.g., a yeast or other fungus), a plant cell (e.g., a tobacco or tomato plant cell), an animal cell (e.g., a human cell, a monkey cell, a hamster cell, a rat cell, a mouse cell, or an insect cell) or a hybridoma. Examples of host cells include Chinese hamster ovary (CHO) cells or their derivatives such as Veggie CHO and related cell lines which grow in serum-free media or CHO strain DX-B11, which is deficient in DHFR. Another example is Human Endothelial Kidney 293 cells or their derivatives. In some embodiments, a host cell is a mammalian cell (e.g., a human cell, a monkey cell, a hamster cell, a rat cell, a mouse cell, or an insect cell).

The term "immunoglobulin" (abbreviated "Ig") as used herein refers to a mammalian immunoglobulin protein including any of the five human classes of antibody: IgA (which includes subclasses IgA1 and IgA2), IgD, IgE, IgG (which includes subclasses IgG1, IgG2, IgG3, and IgG4), and IgM. The term is also inclusive of immunoglobulins that are less than full-length, whether wholly or partially synthetic (e.g., recombinant or chemical synthesis) or naturally produced, such as antigen binding fragment (Fab), variable fragment (Fv) containing $V_H$ and $V_L$, the single chain variable fragment (scFv) containing $V_H$ and $V_L$ linked together in one chain, as well as other antibody V region fragments, such as Fab', F(ab)₂, F(ab')2, dsFv diabody, Fe, and Fd polypeptide fragments. Bispecific antibodies, homo-bispecific and heterobispecific, are included within the meaning of the term.

The term "immunoglobulin superfamily" or "IgSF" as used herein means the group of cell surface and soluble proteins that are involved in the recognition, binding, or adhesion processes of cells. Molecules are categorized as members of this superfamily based on shared structural features with immunoglobulins (i.e., antibodies); they all possess a domain known as an immunoglobulin domain or fold. Members of the IgSF include cell surface antigen receptors, co-receptors and co-stimulatory molecules of the immune system, molecules involved in antigen presentation to lymphocytes, cell adhesion molecules, certain cytokine receptors and intracellular muscle proteins. They are commonly associated with roles in the immune system. Proteins in the immunological synapse are often members of the IgSF. IgSF can also be classified into "subfamilies" based on shared properties such as function. Such subfamilies typically consist of from 4 to 30 IgSF members.

The terms "IgSF domain" or "immunoglobulin domain" or "Ig domain" as used herein refers to a structural domain of IgSF proteins. Ig domains are named after the immunoglobulin molecules. They contain about 70-110 amino acids and are categorized according to their size and function. Ig-domains possess a characteristic Ig-fold, which has a sandwich-like structure formed by two sheets of antiparallel beta strands. Interactions between hydrophobic amino acids on the inner side of the sandwich and highly conserved disulfide bonds formed between cysteine residues in the B and F strands, stabilize the Ig-fold. One end of the Ig domain has a section called the complementarity determining region that is important for the specificity of antibodies for their ligands. The Ig like domains can be classified (into classes) as: IgV, IgC (which either can be an IgC1 or IgC2), or IgI. Most Ig domains are either variable (IgV) or constant (IgC). IgV domains with 9 beta strands are generally longer than IgC domains with 7 beta strands. Ig domains of some members of the IgSF resemble IgV domains in the amino acid sequence, yet are similar in size to IgC domains. These are called IgC2 domains, while standard IgC domains are called IgC1 domains. T-cell receptor (TCR) chains contain two Ig domains in the extracellular portion; one IgV domain at the N-terminus and one IgC1 domain adjacent to the cell membrane. CD155 contains three Ig domains: IgV and two IgC domains that are IgC2 domains.

The term "IgSF species" as used herein means an ensemble of IgSF member proteins with identical or substantially identical primary amino acid sequence. Each mammalian immunoglobulin superfamily (IgSF) member defines a unique identity of all IgSF species that belong to that IgSF member. Thus, each IgSF family member is unique from other IgSF family members and, accordingly, each species of a particular IgSF family member is unique from the species of another IgSF family member. Nevertheless, variation between molecules that are of the same IgSF species may occur owing to differences in post-translational modification such as glycosylation, phosphorylation, ubiquitination, nitrosylation, methylation, acetylation, and lipidation. Additionally, minor sequence differences within a single IgSF species owing to gene polymorphisms constitute another form of variation within a single IgSF species as do wild type truncated forms of IgSF species owing to, for example, proteolytic cleavage. A "cell surface IgSF species" is an IgSF species expressed on the surface of a cell, generally a mammalian cell.

The term "immunological activity" as used herein in the context of mammalian lymphocytes such as T-cells refers to one or more cell survival, cell proliferation, cytokine production (e.g. interferon-gamma), or T-cell cytotoxicity activities. In some cases, an immunological activity can mean the cell expression of cytokines, such as chemokines or interleukins. Assays for determining enhancement or suppression of immunological activity include the MLR (mixed lymphocyte reaction) assays measuring interferon-gamma cytokine levels in culture supernatants (Wang et al., Cancer Immunol Res. 2014 September: 2(9):846-56), SEB (staphylococcal enterotoxin B) T cell stimulation assay (Wang et al., Cancer Immunol Res. 2014 September: 2(9): 846-56), and anti-CD3 T cell stimulation assays (Li and Kurlander, J Transl Med. 2010: 8: 104). Since T cell activation is associated with secretion of IFN-gamma cytokine, detecting IFN-gamma levels in culture supernatants from these in vitro human T cell assays can be assayed using commercial ELISA kits (Wu et al, Immunol Lett 2008 Apr. 15; 117(1): 57-62). Induction of an immune response results in an increase in immunological activity relative to quiescent lymphocytes. An immunomodulatory protein, such as a variant CD155 polypeptide containing an affinity modified IgSF domain, as provided herein can in some embodiments increase or, in alternative embodiments, decrease IFN-gamma (interferon-gamma) expression in a primary T-cell assay relative to a wild-type IgSF member or IgSF domain control. Those of skill will recognize that the format of the primary T-cell assay used to determine an increase in IFN-gamma expression can differ from that employed to assay for a decrease in IFN-gamma expression. In assaying for the ability of an immunomodulatory protein or affinity modified IgSF domain of the invention to alter IFN-gamma expression in a primary T-cell assay, a Mixed Lymphocyte Reaction (MLR) assay can be used. Conveniently, in some cases, a soluble form of an affinity modified IgSF domain of the invention can be employed to determine its ability to increase or decrease the IFN-gamma expression in a MLR. Alternatively, a co-immobilization assay can be used. In a co-immobilization assay, a T-cell receptor signal, provided in some embodiments by anti-CD3 antibody, is used in conjunction with a co-immobilized affinity modified IgSF domain, such as variant CD155, to determine the ability to increase or decrease IFN-gamma expression relative to a wild-type IgSF domain control. Methods to assay the immunological activity of engineered cells, including to evaluate the activity of a variant CD155 transmembrane immunomodulatory protein, are known in the art and include, but are not limited to, the ability to expand T cells following antigen stimulation, sustain T cell expansion in the absence of re-stimulation, and anti-cancer activities in appropriate animal models. Assays also include assays to assess cytotoxicity, including a standard ⁵¹Cr-release assay (see e.g. Milone et al., (2009) Molecular Therapy 17: 1453-1464) or flow based cytotoxicity assays, or an impedance based cytotoxicity assay (Peper et al. (2014) Journal of Immunological Methods, 405:192-198).

An "immunomodulatory polypeptide" or "immunomodulatory protein" is a polypeptide or protein molecule that modulates immunological activity. By "modulation" or "modulating" an immune response is meant that immunological activity is either increased or decreased. An immunomodulatory protein can be a single polypeptide chain or a multimer (dimers or higher order multimers) of at least two polypeptide chains covalently bonded to each other by, for example, interchain disulfide bonds. Thus, monomeric, dimeric, and higher order multimeric polypeptides are within the scope of the defined term. Multimeric polypeptides can be homomultimeric (of identical polypeptide chains) or heteromultimeric (of non-identical polypeptide chains). An immunomodulatory protein of the invention comprises a variant CD155.

The term "increase" as used herein means to increase by a statistically significant amount. An increase can be at least 5%, 10%, 20%, 30%, 40%, 50%, 75%, 100%, or greater than a non-zero control value.

An "isoform" of CD155 is one of a plurality naturally occurring CD155 polypeptides that differ in amino acid sequence. Isoforms can be the product of splice variants of an RNA transcript expressed by a single gene, or the expression product of highly similar but different genes yielding a functionally similar protein such as may occur from gene duplication. As used herein, the term "isoform" of CD155 also refers to the product of different alleles of a CD155 gene.

The term "lymphocyte" as used herein means any of three subtypes of white blood cell in a mammalian immune system. They include natural killer cells (NK cells) (which function in cell-mediated, cytotoxic innate immunity), T cells (for cell-mediated, cytotoxic adaptive immunity), and B cells (for humoral, antibody-driven adaptive immunity). T cells include: T helper cells, cytotoxic T-cells, natural killer T-cells, memory T-cells, regulatory T-cells, or gamma delta T-cells. Innate lymphoid cells (ILC) are also included within the definition of lymphocyte.

The terms "mammal," or "patient" specifically includes reference to at least one of a: human, chimpanzee, rhesus monkey, cynomolgus monkey, dog, cat, mouse, or rat.

The term "membrane protein" as used herein means a protein that, under physiological conditions, is attached directly or indirectly to a lipid bilayer. A lipid bilayer that forms a membrane can be a biological membrane such as a eukaryotic (e.g., mammalian) cell membrane or an artificial (i.e., man-made) membrane such as that found on a liposome. Attachment of a membrane protein to the lipid bilayer can be by way of covalent attachment, or by way of non-covalent interactions such as hydrophobic or electrostatic interactions. A membrane protein can be an integral membrane protein or a peripheral membrane protein. Membrane proteins that are peripheral membrane proteins are non-covalently attached to the lipid bilayer or non-covalently attached to an integral membrane protein. A peripheral membrane protein forms a temporary attachment to the lipid bilayer such that under the range of conditions that are physiological in a mammal, peripheral membrane protein can associate and/or disassociate from the lipid bilayer. In contrast to peripheral membrane proteins, integral membrane proteins form a substantially permanent attachment to the membrane's lipid bilayer such that under the range of conditions that are physiological in a mammal, integral membrane proteins do not disassociate from their attachment to the lipid bilayer. A membrane protein can form an attachment to the membrane by way of one layer of the lipid bilayer (monotopic), or attached by way of both layers of the membrane (polytopic). An integral membrane protein that interacts with only one lipid bilayer is an "integral monotopic protein". An integral membrane protein that interacts with both lipid bilayers is an "integral polytopic protein" alternatively referred to herein as a "transmembrane protein".

The terms "modulating" or "modulate" as used herein in the context of an immune response, such as a mammalian immune response, refer to any alteration, such as an increase or a decrease, of existing or potential immune responses that occurs as a result of administration of an immunomodulatory polypeptide comprising a variant CD155 of the present invention or as a result of administration of engineered cells expresses an immunomodulatory protein, such as a variant CD155 transmembrane immunomodulatory protein of the present invention. Thus, it refers to an alteration, such as an increase or decrease, of an immune response as compared to the immune response that occurs or is present in the absence of the administration of the immunomodulatory protein comprising the variant CD155 or cells expressing such an immunomodulatory polypeptide. Such modulation includes any induction, activation, suppression or alteration in degree or extent of immunological activity of an immune cell. Immune cells include B cells, T cells, NK (natural killer) cells, NK T cells, professional antigen-presenting cells (APCs), and non-professional antigen-presenting cells, and inflammatory cells (neutrophils, macrophages, monocytes, eosinophils, and basophils). Modulation includes any change imparted on an existing immune response, a developing immune response, a potential immune response, or the capacity to induce, regulate, influence, or respond to an immune response. Modulation includes any alteration in the expression and/or function of genes, proteins and/or other molecules in immune cells as part of an immune response. Modulation of an immune response or modulation of immunological activity includes, for example, the following: elimination, deletion, or sequestration of immune cells; induction or generation of immune cells that can modulate the functional capacity of other cells such as autoreactive lymphocytes, antigen presenting cells, or inflammatory cells; induction of an unresponsive state in immune cells (i.e., anergy); enhancing or suppressing the activity or function of immune cells, including but not limited to altering the pattern of proteins expressed by these cells. Examples include altered production and/or secretion of certain classes of molecules such as cytokines, chemokines, growth factors, transcription factors, kinases, costimulatory molecules, or other cell surface receptors or any combination of these modulatory events. Modulation can be assessed, for example, by an alteration in IFN-gamma (interferon gamma) expression relative to the wild-type CD155 control in a primary T cell assay (see, Zhao and Ji, Exp Cell Res. 2016 Jan. 1; 340(1): 132-138). Modulation can be assessed, for example, by an alteration of an immunological activity of engineered cells, such as an alteration in in cytotoxic activity of engineered cells or an alteration in cytokine secretion of engineered cells relative to cells engineered with a wild-type CD155 transmembrane protein The term "molecular species" as used herein means an ensemble of proteins with identical or substantially identical primary amino acid sequence. Each mammalian immunoglobulin superfamily (IgSF) member defines a collection of identical or substantially identical molecular species. Thus, for example, human CD155 is an IgSF member and each human CD155 molecule is a molecular species of CD155. Variation between molecules that are of the same molecular species may occur owing to differences in post-translational modification such as glycosylation, phosphorylation, ubiquitination, nitrosylation, methylation, acetylation, and lipidation. Additionally, minor sequence differences within a single molecular species owing to gene polymorphisms constitute another form of variation within a single molecular species as do wild type truncated forms of a single molecular species owing to, for example, proteolytic cleavage. A "cell surface molecular species" is a molecular species expressed on the surface of a mammalian cell. Two or more different species of protein, each of which is present exclusively on one or exclusively the other (but not both) of the two mammalian cells forming the IS, are said to be in "cis" or "cis configuration" with each other. Two different species of protein, the first of which is exclusively present on one of the two mammalian cells forming the IS and the second of which is present exclusively on the second of the two mammalian cells forming the IS, are said to be in "trans" or "trans configuration." Two different species of protein each of which is present on both of the two mammalian cells forming the IS are in both cis and trans configurations on these cells.

The term, a "multimerization domain" refers to a sequence of amino acids that promotes stable interaction of a polypeptide molecule with one or more additional polypeptide molecules, each containing a complementary multimerization domain (e.g. a first multimerization domain and a second multimerization domain), which can be the same or a different multimerization domain. The interactions between complementary multimerization domains, e.g. interaction between a first multimerication domain and a second multimerization domain, form a stable protein-protein interaction to produce a multimer of the polypeptide molecule with the additional polypeptide molecule. In some cases, the multimerization domain is the same and interacts with itself to form a stable proten-protein interaction between two polypeptide chains. Generally, a polypeptide is joined directly or indirectly to the multimerization domain. Exemplary multimerization domains include the immunoglobulin sequences or portions thereof, leucine zippers, hydrophobic regions, hydrophilic regions, and compatible protein-protein interaction domains. The multimerization domain, for example, can be an immunoglobulin constant region or domain, such as, for example, the Fc domain or portions thereof from IgG, including IgG1, IgG2, IgG3 or IgG4 subtypes, IgA, IgE, IgD and IgM and modified forms thereof.

The terms "nucleic acid" and "polynucleotide" are used interchangeably to refer to a polymer of nucleic acid residues (e.g., deoxyribonucleotides or ribonucleotides) in either single- or double-stranded form. Unless specifically limited, the terms encompass nucleic acids containing known analogues of natural nucleotides and that have similar binding properties to it and are metabolized in a manner similar to naturally-occurring nucleotides. Unless otherwise indicated, a particular nucleic acid sequence also implicitly encompasses conservatively modified variants thereof (e.g., degenerate codon substitutions) and complementary nucleotide sequences as well as the sequence explicitly indicated (a "reference sequence"). Specifically, degenerate codon substitutions may be achieved by generating sequences in which the third position of one or more selected (or all) codons is substituted with mixed-base and/or deoxyinosine residues. The term nucleic acid or polynucleotide encompasses cDNA or mRNA encoded by a gene.

The term "non-competitive binding" as used herein means the ability of a protein to specifically bind simultaneously to at least two cognate binding partners. Thus, the protein is able to bind to at least two different cognate binding partners at the same time, although the binding interaction need not be for the same duration such that, in some cases, the protein is specifically bound to only one of the cognate binding partners. In some embodiments, the binding occurs under specific binding conditions. In some embodiments, the simultaneous binding is such that binding of one cognate binding partner does not substantially inhibit simultaneous binding to a second cognate binding partner. In some embodiments, non-competitive binding means that binding a second cognate binding partner to its binding site on the protein does not displace the binding of a first cognate binding partner to its binding site on the protein. Methods of assessing non-competitive binding are well known in the art such as the method described in Perez de La Lastra et al., Immunology, 1999 April: 96(4): 663-670. In some cases, in non-competitive interactions, the first cognate binding partner specifically binds at an interaction site that does not overlap with the interaction site of the second cognate binding partner such that binding of the second cognate binding partner does not directly interfere with the binding of the first cognate binding partner. Thus, any effect on binding of the cognate binding partner by the binding of the second cognate binding partner is through a mechanism other than direct interference with the binding of the first cognate binding partner. For example, in the context of enzyme-substrate interactions, a non-competitive inhibitor binds to a site other than the active site of the enzyme. Non-competitive binding encompasses uncompetitive binding interactions in which a second cognate binding partner specifically binds at an interaction site that does not overlap with the binding of the first cognate binding partner but binds to the second interaction site only when the first interaction site is occupied by the first cognate binding partner.

The term "pharmaceutical composition" refers to a composition suitable for pharmaceutical use in a mammalian subject, often a human. A pharmaceutical composition typically comprises an effective amount of an active agent (e.g., an immunomodulatory polypeptide comprising a variant CD155 or engineered cells expressing a variant CD155 transmembrane immunomodulatory protein) and a carrier, excipient, or diluent. The carrier, excipient, or diluent is typically a pharmaceutically acceptable carrier, excipient or diluent, respectively.

The terms "polypeptide" and "protein" are used interchangeably herein and refer to a molecular chain of two or more amino acids linked through peptide bonds. The terms do not refer to a specific length of the product. Thus, "peptides," and "oligopeptides," are included within the definition of polypeptide. The terms include post-translational modifications of the polypeptide, for example, glycosylations, acetylations, phosphorylations and the like. The terms also include molecules in which one or more amino acid analogs or non-canonical or unnatural amino acids are included as can be synthesized, or expressed recombinantly using known protein engineering techniques. In addition, proteins can be derivatized.

The term "primary T-cell assay" as used herein refers to an in vitro assay to measure interferon-gamma ("IFN-gamma") expression. A variety of such primary T-cell assays are known in the art. In a preferred embodiment, the assay used is an anti-CD3 coimmobilizaton assay. In this assay, primary T cells are stimulated by anti-CD3 immobilized with or without additional recombinant proteins. Culture supernatants are harvested at timepoints, usually 24-72 hours. In another embodiment, the assay used is the MLR. In this assay, primary T cells are stimulated with allogeneic APC. Culture supernatants are harvested at timepoints, usually 24-72 hours. Human IFN-gamma levels are measured in culture supernatants by standard ELISA techniques. Commercial kits are available from vendors and the assay is performed according to manufacturer's recommendation.

The term "purified" as applied to nucleic acids, such as encoding immunomodulatory proteins of the invention, generally denotes a nucleic acid or polypeptide that is substantially free from other components as determined by analytical techniques well known in the art (e.g., a purified polypeptide or polynucleotide forms a discrete band in an electrophoretic gel, chromatographic eluate, and/or a media subjected to density gradient centrifugation). For example, a nucleic acid or polypeptide that gives rise to essentially one band in an electrophoretic gel is "purified." A purified nucleic acid or protein of the invention is at least about 50% pure, usually at least about 75%, 80%, 85%, 90%, 95%, 96%, 99% or more pure (e.g., percent by weight or on a molar basis).

The term "recombinant" indicates that the material (e.g., a nucleic acid or a polypeptide) has been artificially (i.e., non-naturally) altered by human intervention. The alteration can be performed on the material within, or removed from, its natural environment or state. For example, a "recombinant nucleic acid" is one that is made by recombining nucleic acids, e.g., during cloning, affinity modification, DNA shuffling or other well-known molecular biological procedures. A "recombinant DNA molecule," is comprised of segments of DNA joined together by means of such molecular biological techniques. The term "recombinant protein" or "recombinant polypeptide" as used herein refers to a protein molecule which is expressed using a recombinant DNA molecule. A "recombinant host cell" is a cell that contains and/or expresses a recombinant nucleic acid or that is otherwise altered by genetic engineering, such as by introducing into the cell a nucleic acid molecule encoding a recombinant protein, such as a transmembrane immunomodulatory protein provided herein. Transcriptional control signals in eukaryotes comprise "promoter" and "enhancer" elements. Promoters and enhancers consist of short arrays of DNA sequences that interact specifically with cellular proteins involved in transcription. Promoter and enhancer elements have been isolated from a variety of eukaryotic sources including genes in yeast, insect and mammalian cells and viruses (analogous control elements, i.e., promoters, are also found in prokaryotes). The selection of a particular promoter and enhancer depends on what cell type is to be used to express the protein of interest. The terms "in operable combination," "in operable order" and "operably linked" as used herein refer to the linkage of nucleic acid sequences in such a manner or orientation that a nucleic acid molecule capable of directing the transcription of a given gene and/or the synthesis of a desired protein molecule is produced.

The term "recombinant expression vector" as used herein refers to a DNA molecule containing a desired coding sequence and appropriate nucleic acid sequences necessary for the expression of the operably linked coding sequence in a particular host cell. Nucleic acid sequences necessary for expression in prokaryotes include a promoter, optionally an operator sequence, a ribosome binding site and possibly other sequences. Eukaryotic cells are known to utilize promoters, enhancers, and termination and polyadenylation signals. A secretory signal peptide sequence can also, optionally, be encoded by the recombinant expression vector, operably linked to the coding sequence for the recombinant protein, such as a recombinant fusion protein, so that the expressed fusion protein can be secreted by the recombinant host cell, for easier isolation of the fusion protein from the cell, if desired. The term includes the vector as a self-replicating nucleic acid structure as well as the vector incorporated into the genome of a host cell into which it has been introduced. Among the vectors are viral vectors, such as lentiviral vectors.

The term "selectivity" refers to the preference of a subject protein, or polypeptide, for specific binding of one substrate, such as one cognate binding partner, compared to specific binding for another substrate, such as a different cognate binding partner of the subject protein. Selectivity can be reflected as a ratio of the binding activity (e.g. binding affinity) of a subject protein and a first substrate, such as a first cognate binding partner, (e.g., Kd1) and the binding activity (e.g. binding affinity) of the same subject protein with a second cognate binding partner (e.g., $K_{d2}$).

The term "sequence identity" as used herein refers to the sequence identity between genes or proteins at the nucleotide or amino acid level, respectively. "Sequence identity" is a measure of identity between proteins at the amino acid level and a measure of identity between nucleic acids at nucleotide level. The protein sequence identity may be determined by comparing the amino acid sequence in a given position in each sequence when the sequences are aligned. Similarly, the nucleic acid sequence identity may be determined by comparing the nucleotide sequence in a given position in each sequence when the sequences are aligned. Methods for the alignment of sequences for comparison are well known in the art, such methods include GAP, BESTFIT, BLAST, FASTA and TFASTA. The BLAST algorithm calculates percent sequence identity and performs a statistical analysis of the similarity between the two sequences. The software for performing BLAST analysis is publicly available through the National Center for Biotechnology Information (NCBI) website.

The term "soluble" as used herein in reference to proteins, means that the protein is not a membrane protein. In general, a soluble protein contains only the extracellular domain of an IgSF family member receptor, or a portion thereof containing an IgSF domain or domains or specific-binding fragments thereof, but does not contain the transmembrane domain. In some cases, solubility of a protein can be improved by linkage or attachment, directly or indirectly via a linker, to an Fc domain, which, in some cases, also can improve the stability and/or half-life of the protein. In some aspects, a soluble protein is an Fc fusion protein.

The term "species" as used herein with respect to polypeptides or nucleic acids means an ensemble of molecules with identical or substantially identical sequences. Variation between polypeptides that are of the same species may occur owing to differences in post-translational modification such as glycosylation, phosphorylation, ubiquitination, nitrosylation, methylation, acetylation, and lipidation. Slightly truncated sequences of polypeptides that differ (or encode a difference) from the full length species at the amino-terminus or carboxy-terminus by no more than 1, 2, or 3 amino acid residues are considered to be of a single species. Such microheterogeneities are a common feature of manufactured proteins.

The term "specific binding fragment" as used herein in reference to a full-length wild-type mammalian CD155 polypeptide or an IgV or an IgC (e.g. IgC2) domain thereof, means a polypeptide having a subsequence of the full-length polypeptide or an IgV and/or IgC domain and that specifically binds in vitro and/or in vivo to a mammalian TIGIT, mammalian CD226, and/or mammalian CD96 such as a human or murine TIGIT, CD226, or CD96. In some embodiments, the specific binding fragment comprises an CD155 IgV, a CD155 IgC2 subsequence that is at least 60%, 70%, 75%, 80%, 85%, 90%, 95%, 96%, 97%, 98%, or 99% the sequence length of the full-length wild-type sequence or an IgV or an IgC (e.g. IgC2) sequence thereof. The specific binding fragment can be altered in sequence to form a variant CD155 of the invention.

The term "specifically binds" as used herein means the ability of a protein, under specific binding conditions, to bind to a target protein such that its affinity or avidity is at least 5 times as great, but optionally at least 10, 20, 30, 40, 50, 100, 250 or 500 times as great, or even at least 1000 times as great as the average affinity or avidity of the same protein to a collection of random peptides or polypeptides of sufficient statistical size. A specifically binding protein need not bind exclusively to a single target molecule but may specifically bind to a non-target molecule due to similarity in structural conformation between the target and non-target (e.g., paralogs or orthologs). Those of skill will recognize that specific binding to a molecule having the same function in a different species of animal (i.e., ortholog) or to a non-target molecule having a substantially similar epitope as the target molecule (e.g., paralog) is possible and does not detract from the specificity of binding which is determined relative to a statistically valid collection of unique non-targets (e.g., random polypeptides). Thus, a polypeptide of the invention may specifically bind to more than one distinct species of target molecule due to cross-reactivity. Solid-phase ELISA immunoassays, ForteBio Octet, or Biacore measurements can be used to determine specific binding between two proteins. Generally, interactions between two binding proteins have dissociation constants ($K_d$) less than $1\times10^{-5}$ M, and often as low as $1\times10^{-12}$ M. In certain embodiments of the present disclosure, interactions between two binding proteins have dissociation constants of less than or less than about $1\times10^{-6}$ M, $1\times10^{-7}$ M, $1\times10^{-8}$ M, $1\times10^{-9}$ M, $1\times10^{-10}$ M or $1\times10^{-11}$ M or less.

The terms "surface expresses" or "surface expression" in reference to a mammalian cell expressing a polypeptide means that the polypeptide is expressed as a membrane protein. In some embodiments, the membrane protein is a transmembrane protein.

As used herein, "synthetic," with reference to, for example, a synthetic nucleic acid molecule or a synthetic gene or a synthetic peptide refers to a nucleic acid molecule or polypeptide molecule that is produced by recombinant methods and/or by chemical synthesis methods.

The term "targeting moiety" as used herein refers to a composition that is covalently or non-covalently attached to, or physically encapsulates, a polypeptide comprising a variant CD155 of the present invention. The targeting moiety has specific binding affinity for a desired counter-structure such as a cell surface receptor (e.g., the B7 family member PD-L1), or a tumor antigen such as tumor specific antigen (TSA) or a tumor associated antigen (TAA) such as B7-H6. Typically, the desired counter-structure is localized on a specific tissue or cell-type. Targeting moieties include: antibodies, antigen binding fragment (Fab), variable fragment (Fv) containing $V_H$ and $V_L$, the single chain variable fragment (scFv) containing $V_H$ and $V_L$ linked together in one chain, as well as other antibody V region fragments, such as Fab', F(ab)$_2$, F(ab')2, dsFv diabody, nanobodies, soluble receptors, receptor ligands, affinity matured receptors or ligands, as well as small molecule (<500 dalton) compositions (e.g., specific binding receptor compositions). Targeting moieties can also be attached covalently or non-covalently to the lipid membrane of liposomes that encapsulate a polypeptide of the present invention.

The term "transmembrane protein" as used herein means a membrane protein that substantially or completely spans a lipid bilayer such as those lipid bilayers found in a biological membrane such as a mammalian cell, or in an artificial construct such as a liposome. The transmembrane protein comprises a transmembrane domain ("transmembrane domain") by which it is integrated into the lipid bilayer and by which the integration is thermodynamically stable under physiological conditions. Transmembrane domains are generally predictable from their amino acid sequence via any number of commercially available bioinformatics software applications on the basis of their elevated hydrophobicity relative to regions of the protein that interact with aqueous environments (e.g., cytosol, extracellular fluid). A transmembrane domain is often a hydrophobic alpha helix that spans the membrane. A transmembrane protein can pass through the both layers of the lipid bilayer once or multiple times. A transmembrane protein includes the provided transmembrane immunomodulatory proteins described herein. In addition to the transmembrane domain, a transmembrane immunomodulatory protein of the invention further comprises an ectodomain and, in some embodiments, an endodomain.

The terms "treating," "treatment," or "therapy" of a disease or disorder as used herein mean slowing, stopping or reversing the disease or disorders progression, as evidenced by decreasing, cessation or elimination of either clinical or diagnostic symptoms, by administration of a therapeutic composition (e.g. containing an immunomodulatory protein or engineered cells) of the invention either alone or in combination with another compound as described herein. "Treating," "treatment," or "therapy" also means a decrease in the severity of symptoms in an acute or chronic disease or disorder or a decrease in the relapse rate as for example in the case of a relapsing or remitting autoimmune disease course or a decrease in inflammation in the case of an inflammatory aspect of an autoimmune disease. As used herein in the context of cancer, the terms "treatment" or, "inhibit," "inhibiting" or "inhibition" of cancer refers to at least one of: a statistically significant decrease in the rate of tumor growth, a cessation of tumor growth, or a reduction in the size, mass, metabolic activity, or volume of the tumor, as measured by standard criteria such as, but not limited to, the Response Evaluation Criteria for Solid Tumors (RECIST), or a statistically significant increase in progression free survival (PFS) or overall survival (OS). "Preventing," "prophylaxis," or "prevention" of a disease or disorder as used in the context of this invention refers to the administration of an immunomodulatory polypeptide or engineered cells of the invention, either alone or in combination with another compound, to prevent the occurrence or onset of a disease or disorder or some or all of the symptoms of a disease or disorder or to lessen the likelihood of the onset of a disease or disorder.

The term "tumor specific antigen" or "TSA" as used herein refers to a counter-structure that is present primarily on tumor cells of a mammalian subject but generally not found on normal cells of the mammalian subject. A tumor specific antigen need not be exclusive to tumor cells but the percentage of cells of a particular mammal that have the tumor specific antigen is sufficiently high or the levels of the tumor specific antigen on the surface of the tumor are sufficiently high such that it can be targeted by anti-tumor therapeutics, such as immunomodulatory polypeptides of the invention, and provide prevention or treatment of the mammal from the effects of the tumor. In some embodiments, in a random statistical sample of cells from a mammal with a tumor, at least 50% of the cells displaying a TSA are cancerous. In other embodiments, at least 60%, 70%, 80%, 85%, 90%, 95%, or 99% of the cells displaying a TSA are cancerous.

The term "variant" (also "modified" or mutant") as used in reference to a variant CD155 means a CD155, such as a mammalian (e.g., human or murine) CD155 created by human intervention. The variant CD155 is a polypeptide having an altered amino acid sequence, relative to an unmodified or wild-type CD155. The variant CD155 is a polypeptide which differs from a wild-type CD155 isoform sequence by one or more amino acid substitutions, deletions, additions, or combinations thereof. For purposes herein, the variant CD155 contains at least one affinity modified domain, whereby one or more of the amino acid differences occurs in an IgSF domain (e.g. IgV domain). A variant CD155 can contain 1, 2, 3, 4, 5, 6, 7, 8, 9, 10, 11, 12, 13, 14, 15, 16, 17, 18, 19, 20, 21, 22, 23, 24, 25, 26, 27, 28, 29, 30 or more amino acid differences, such as amino acid substitutions. A variant CD155 polypeptide generally exhibits at least 50%, 60%, 70%, 80%, 85%, 86%, 87%, 88%, 89%, 90%, 91%, 92%, 93%, 94%, 95%, 96%, 97%, 98%, 99% or more sequence identity to a corresponding wild-type or unmodified CD155, such as to the sequence of SEQ ID NO:20, a mature sequence thereof (lacking the signal sequence) or a portion thereof containing the extracellular domain or an IgSF domain thereof. In some embodiments, a variant CD155 polypeptide exhibits at least 50%, 60%, 70%, 80%, 85%, 86%, 87%, 88%, 89%, 90%, 91%, 92%, 93%, 94%, 95%, 96%, 97%, 98%, 99% or more sequence identity to a corresponding wild-type or unmodified CD155 comprising the sequence set forth in SEQ ID NO:47 or SEQ ID NO: 58 or 155. Non-naturally occurring amino acids as well as naturally occurring amino acids are included within the scope of permissible substitutions or additions. A variant CD155 is not limited to any particular method of making and includes, for example, de novo chemical synthesis, de novo recombinant DNA techniques, or combinations thereof. A variant CD155 of the invention specifically binds to at least one or more of: TIGIT, CD226, or CD96 of a mammalian species. In some embodiments, the altered amino acid sequence results in an altered (i.e., increased or decreased) binding affinity or avidity to TIGIT, CD226, and/or CD96 compared to the wild-type or unmodified CD155 protein. An increase or decrease in binding affinity or avidity can be determined using well known binding assays such as flow cytometry. Larsen et al., American Journal of Transplantation, Vol 5: 443-453 (2005). See also, Linsley et al., Immunity, Vol 1 (9): 793-801 (1994). An increase in variant CD155 binding affinity or avidity to TIGIT, CD226, and/or CD96 is to a value at least 5% greater than that of the wild-type or unmodified CD155 and in some embodiments, at least 10%, 15%, 20%, 30%, 40%, 50%, 100% greater than that of the wild-type or unmodified CD155 control value. A decrease in CD155 binding affinity or avidity to TIGIT, CD226, and/or CD96 is to a value no greater than 95% of the wild-type or unmodified control values, and in some embodiments no greater than 80%, 70% 60%, 50%, 40%, 30%, 20%, 10%, 5%, or no detectable binding affinity or avidity of the wild-type or unmodified control values. A variant CD155 is altered in primary amino acid sequence by substitution, addition, or deletion of amino acid residues. The term "variant" in the context of variant CD155 is not to be construed as imposing any condition for any particular starting composition or method by which the variant CD155 is created. A variant CD155 can, for example, be generated starting from wild type mammalian CD155 sequence information, then modeled in silico for binding to TIGIT, CD226, and/or CD96, and finally recombinantly or chemically synthesized to yield a variant CD155 of the present invention. In but one alternative example, a variant CD155 can be created by site-directed mutagenesis of a wild-type CD155. Thus, variant CD155 denotes a composition and not necessarily a product produced by any given process. A variety of techniques including recombinant methods, chemical synthesis, or combinations thereof, may be employed.

The term "wild-type" or "natural" or "native" as used herein is used in connection with biological materials such as nucleic acid molecules, proteins (e.g., CD155), IgSF members, host cells, and the like, refers to those which are found in nature and not modified by human intervention.

II. Variant CD155 Polypeptides

Provided herein are variant CD155 polypeptides that exhibit altered (increased or decreased) binding activity or affinity for one or more of a CD155 cognate binding partner. In some embodiments, the CD155 cognate binding partner is TIGIT, CD226, or CD96. In some embodiments, the CD155 cognate binding partner is TIGIT or CD226. In some embodiments, the variant CD155 polypeptide contains one or more amino acids modifications, such as one or more substitutions (alternatively, "mutations" or "replacements"), deletions or addition, in an immunoglobulin superfamily (IgSF) domain (IgD) relative to a wild-type or unmodified CD155 polypeptide or a portion of a wild-type or unmodified CD155 containing the IgD or a specific binding fragment thereof. Thus, a provided variant CD155 polypeptide is or comprises a variant IgD (hereinafter called "vIgD") in which the one or more amino acid modifications (e.g. substitutions) is in an IgD.

In some embodiments, the IgD comprises an IgV domain or an IgC (e.g. IgC2) domain or specific binding fragment of the IgV domain or the IgC (e.g. IgC2) domain, or combinations thereof. In some embodiments, the IgD can be an IgV only, the combination of the IgV and IgC, including the entire extracellular domain (ECD), or any combination of Ig domains of CD155. Table 2 provides exemplary residues that correspond to IgV or IgC regions of CD155. In some embodiments, the variant CD155 polypeptide contains an IgV domain or an IgC domain or specific binding fragments thereof in which the at least one of the amino acid modifications (e.g. substitutions) is in the IgV domain or IgC domain or a specific binding fragment thereof. In some embodiments, the variant CD155 polypeptide contains an IgV domain or specific binding fragments thereof in which the at least one of the amino acid modifications (e.g. substitutions) is in the IgV domain or a specific binding fragment thereof. In some embodiments, by virtue of the altered binding activity or affinity, the altered IgV domain or IgC (e.g. IgC2) domain is an affinity-modified IgSF domain.

In some embodiments, the variant is modified in one more IgSF domains relative to the sequence of an unmodified CD155 sequence. In some embodiments, the unmodified CD155 sequence is a wild-type CD155. In some embodiments, the unmodified or wild-type CD155 has the sequence of a native CD155 or an ortholog thereof. In some embodiments, the unmodified CD155 is or comprises the extracellular domain (ECD) of CD155 or a portion thereof containing one or more IgSF domain (see Table 2). In some embodiments, the extracellular domain of an unmodified or wild-type CD155 polypeptide comprises an IgV domain and an IgC (e.g. IgC2) domain or domains. However, the variant CD155 polypeptide need not comprise both the IgV domain and the IgC (e.g. IgC2) domain or domains. In some embodiments, the variant CD155 polypeptide comprises or consists essentially of the IgV domain or a specific binding fragment thereof. In some embodiments, the variant CD155 polypeptide comprises or consists essentially of one or both of the IgC (e.g. IgC2) domain or specific binding fragments thereof. In some embodiments, the variant CD155 polypeptide comprises or consists essentially of only one of the IgC (e.g. IgC2) domain or a specific binding fragment thereof. In some embodiments, the variant CD155 polypeptide comprises the IgV domain or a specific binding fragment thereof, and the first and second IgC (e.g. IgC2) domains or specific binding fragment thereof. In some embodiments, the variant CD155 is soluble and lacks a transmembrane domain. In some embodiments, the variant CD155 further comprises a transmembrane domain and, in some cases, also a cytoplasmic domain.

In some embodiments, the wild-type or unmodified CD155 sequence is a mammalian CD155 sequence. In some embodiments, the wild-type or unmodified CD155 sequence can be a mammalian CD155 that includes, but is not limited to, human, mouse, cynomolgus monkey, or rat. In some embodiments, the wild-type or unmodified CD155 sequence is human.

In some embodiments, the wild-type or unmodified CD155 sequence has (i) the sequence of amino acids set forth in SEQ ID NO:20 or a mature form thereof lacking the signal sequence, (ii) a sequence of amino acids that exhibits at least 85%, 86%, 87%, 88%, 89%, 90%, 91%, 92%, 93%, 94%, 95%, 96%, 97%, 98%, 99% or more sequence identity to SEQ ID NO:20 or the mature form thereof, or (iii) is a portion of (i) or (ii) containing an IgV domain or IgC (e.g. IgC2) domain or specific binding fragments thereof.

In some embodiments, the wild-type or unmodified CD155 sequence is or comprises an extracellular domain of the CD155 or a portion thereof. In some embodiments, the unmodified or wild-type CD155 polypeptide comprises the amino acid sequence set forth in SEQ ID NO: 47, or an ortholog thereof. In some cases, the unmodified or wild-type CD155 polypeptide can comprise (i) the sequence of amino acids set forth in SEQ ID NO: 47, (ii) a sequence of amino acids that has at least about 85%, 86%, 87%, 88%, 89%, 90%, 91%, 92%, 93%, 94%, 95%, 96%, 97%, 98%, 99% sequence identity to SEQ ID NO: 47, or (iii) is a specific binding fragment of the sequence of (i) or (ii) comprising an IgV domain or an IgC (e.g. IgC2) domain.

In some embodiments, the wild-type or unmodified CD155 polypeptide comprises an IgV domain or an IgC (e.g. IgC2) domain or domains, or a specific binding fragment thereof. In some embodiments, the IgV domain of the wild-type or unmodified CD155 polypeptide comprises the amino acid sequence set forth in SEQ ID NO: 58 or 155 (corresponding to amino acid residues 24-139 or 21-142, respectively, of SEQ ID NO: 20), or an ortholog thereof. For example, the IgV domain of the unmodified or wild-type CD155 polypeptide can contain (i) the sequence of amino acids set forth in SEQ ID NO: 58 or 155, (ii) a sequence of amino acids that has at least about 85%, 86%, 87%, 88%, 89%, 90%, 91%, 92%, 93%, 94%, 95%, 96%, 97%, 98%, 99% sequence identity to SEQ ID NO: 58 or 155, or (iii) a specific binding fragment of the sequence of (i) or (ii). In some embodiments, the wild-type or unmodified IgV domain is capable of binding one or more CD155 cognate binding proteins, such as one or more of TIGIT, CD226, or CD96.

In some embodiments, a first IgC2 domain of the wild-type or unmodified CD155 polypeptide comprises the amino acid sequence set forth as residues 145-237 of SEQ ID NO:

20, or an ortholog thereof. For example, an IgC2 domain of the unmodified or wild-type CD155 polypeptide can contain (i) the sequence of amino acids set forth as residues 145-237 of SEQ ID NO: 20, (ii) a sequence of amino acids that has at least about 85%, 86%, 87%, 88%, 89%, 90%, 91%, 92%, 93%, 94%, 95%, 96%, 97%, 98%, 99% sequence identity to residues 145-237 of SEQ ID NO: 20, or (iii) a specific binding fragment of (i) or (ii). In some embodiments, the second IgC2 domain of the wild-type or unmodified CD155 polypeptide comprises the amino acid sequence set forth as residues 244-328 of SEQ ID NO: 20, or an ortholog thereof. For example, an IgC2 domain of the unmodified or wild-type CD155 polypeptide can contain (i) the sequence of amino acids set forth as residues 244-328 of SEQ ID NO: 20, (ii) a sequence of amino acids that has at least about 85%, 86%, 87%, 88%, 89%, 90%, 91%, 92%, 93%, 94%, 95%, 96%, 97%, 98%, 99% sequence identity to residues 244-328 of SEQ ID NO: 20, or (iii) a specific binding fragment of (i) or (ii). In some embodiments, one or both of the wild-type or unmodified IgC domain is capable of binding one or more CD155 cognate binding proteins.

In some embodiments, the wild-type or unmodified CD155 polypeptide contains a specific binding fragment of CD155, such as a specific binding fragment of the IgV domain or the IgC (e.g. IgC2) domain. In some embodiments the specific binding fragment can bind TIGIT, CD226, and/or CD96. The specific binding fragment can have an amino acid length of at least 50 amino acids, such as at least 60, 70, 80, 90, 100, or 110 amino acids. In some embodiments, a specific binding fragment of the IgV domain contains an amino acid sequence that is at least about 85%, 86%, 87%, 88%, 89%, 90%, 91%, 92%, 93%, 94%, 95%, 96%, 97%, 98%, 99% of the length of the IgV domain set forth as amino acids 24-139 of SEQ ID NO: 20. In some embodiments, a specific binding fragment of an IgC (e.g. IgC2) domain comprises an amino acid sequence that is at least about 85%, 86%, 87%, 88%, 89%, 90%, 91%, 92%, 93%, 94%, 95%, 96%, 97%, 98%, 99% of the length of the IgC domain set forth as amino acids 145-237 of SEQ ID NO: 20. In some embodiments, a specific binding fragment of an IgC (e.g. IgC2) domain comprises an amino acid sequence that is at least about 85%, 86%, 87%, 88%, 89%, 90%, 91%, 92%, 93%, 94%, 95%, 96%, 97%, 98%, 99% of the length of the IgC domain set forth as amino acids 244-328 of SEQ ID NO: 20.

In some embodiments, the variant CD155 polypeptide comprises the ECD domain or a portion thereof comprising one or more affinity modified IgSF domains. In some embodiments, the variant CD155 polypeptides can comprise an IgV domain or an IgC (e.g. IgC2) domain or domains, or a specific binding fragment of the IgV domain or a specific binding fragment of the IgC (e.g. IgC2) domain or domains in which one or more of the IgSF domains (IgV or IgC) contains the one or more amino acid modifications (e.g. substitutions). In some embodiments, the variant CD155 polypeptides can comprise an IgV domain and an IgC (e.g. IgC2) domain or domains, or a specific binding fragment of the IgV domain and a specific binding fragment of the IgC (e.g. IgC2) domain or domains, in which at least one of the IgV or IgC domain contains the amino acid modification(s) (e.g. substitutions). In some embodiments, the variant CD155 polypeptide comprises a full-length IgV domain. In some embodiments, the variant CD155 polypeptide comprises a full-length IgC (e.g. IgC2) domain or domains. In some embodiments, the variant CD155 polypeptide comprises a specific binding fragment of the IgV domain. In some embodiments, the variant CD155 polypeptide comprises a specific binding fragment of the IgC (e.g. IgC2) domain or domains. In some embodiments, the variant CD155 polypeptide comprises a full-length IgV domain and a full-length IgC (e.g. IgC2) domain or domains. In some embodiments, the variant CD155 polypeptide comprises a full-length IgV domain and a specific binding fragment of an IgC (e.g. IgC2) domain or domains. In some embodiments, the variant CD155 polypeptide comprises a specific binding fragment of an IgV domain and a full-length IgC (e.g. IgC2) domain or domains. In some embodiments, the variant CD155 polypeptide comprises a specific binding fragment of an IgV domain and a specific binding fragment of an IgC (e.g. IgC2) domain or domains.

In any of such embodiments, the one or more amino acid modifications (e.g. substitutions) of the variant CD155 polypeptides can be located in any one or more of the CD155 polypeptide IgSF domains. For example, in some embodiments, one or more amino acid modifications (e.g. substitutions) are located in the extracellular domain of the variant CD155 polypeptide. In some embodiments, one or more amino acid modifications (e.g. substitutions) are located in the IgV domain or specific binding fragment of the IgV domain. In some embodiments, one or more amino acid modifications (e.g. substitutions) are located in an IgC (e.g. IgC2) domain or specific binding fragment of an IgC (e.g. IgC2) domain.

Generally, each of the various attributes of polypeptides are separately disclosed below (e.g., soluble and membrane bound polypeptides, affinity of CD155 for TIGIT, CD226, and CD96, number of variations per polypeptide chain, number of linked polypeptide chains, the number and nature of amino acid alterations per variant CD155, etc.). However, as will be clear to the skilled artisan, any particular polypeptide can comprise a combination of these independent attributes. It is understood that reference to amino acids, including to a specific sequence set forth as a SEQ ID NO used to describe domain organization of an IgSF domain are for illustrative purposes and are not meant to limit the scope of the embodiments provided. It is understood that polypeptides and the description of domains thereof are theoretically derived based on homology analysis and alignments with similar molecules. Thus, the exact locus can vary, and is not necessarily the same for each protein. Hence, the specific IgSF domain, such as specific IgV domain or IgC domain, can be several amino acids (such as one, two, three or four) longer or shorter.

Further, various embodiments of the invention as discussed below are frequently provided within the meaning of a defined term as disclosed above. The embodiments described in a particular definition are therefore to be interpreted as being incorporated by reference when the defined term is utilized in discussing the various aspects and attributes described herein. Thus, the headings, the order of presentation of the various aspects and embodiments, and the separate disclosure of each independent attribute is not meant to be a limitation to the scope of the present disclosure.

Exemplary Modifications

Provided herein are variant CD155 polypeptides containing at least one affinity-modified IgSF domain (e.g. IgV or IgC) or a specific binding fragment thereof relative to an IgSF domain contained in a wild-type or unmodified CD155 polypeptide such that the variant CD155 polypeptide exhibits altered (increased or decreased) binding activity or affinity for one or more ligands TIGIT, CD226, or CD96 compared to a wild-type or unmodified CD155 polypeptide. In some embodiments, a variant CD155 polypeptide has a binding affinity for TIGIT, CD226, and/or CD96 that differs from that of a wild-type or unmodified CD155 polypeptide control sequence as determined by, for example, solid-phase ELISA immunoassays, flow cytometry, ForteBio Octet or Biacore assays. In some embodiments, the variant CD155 polypeptide has an increased binding affinity for TIGIT, CD226, and/or CD96. In some embodiments, the variant CD155 polypeptide has a decreased binding affinity for TIGIT, CD226, and/or CD96, relative to a wild-type or unmodified CD155 polypeptide. The TIGIT, CD226, and/or the CD96 can be a mammalian protein, such as a human protein or a murine protein.

Binding affinities for each of the cognate binding partners are independent; that is, in some embodiments, a variant CD155 polypeptide has an increased binding affinity for one, two or three of TIGIT, CD226, and/or CD96, and a decreased binding affinity for one, two or three of TIGIT, CD226, and CD96, relative to a wild-type or unmodified CD155 polypeptide.

In some embodiments, the variant CD155 polypeptide has an increased binding affinity for TIGIT, relative to a wild-type or unmodified CD155 polypeptide. In some embodiments, the variant CD155 polypeptide has an increased binding affinity for CD226, relative to a wild-type or unmodified CD155 polypeptide. In some embodiments, the variant CD155 polypeptide has an increased binding affinity for CD96, relative to a wild-type or unmodified CD155 polypeptide. In some embodiments, the variant CD155 polypeptide has a decreased binding affinity for TIGIT, relative to a wild-type or unmodified CD155 polypeptide. In some embodiments, the variant CD155 polypeptide has a decreased binding affinity for CD226, relative to a wild-type or unmodified CD155 polypeptide. In some embodiments, the variant CD155 polypeptide has a decreased binding affinity for CD96, relative to a wild-type or unmodified CD155 polypeptide.

In some embodiments, the variant CD155 polypeptide has an increased binding affinity for TIGIT and CD226, relative to a wild-type or unmodified CD155 polypeptide. In some embodiments, the variant CD155 polypeptide has an increased binding affinity for TIGIT and a decreased binding affinity for CD226, relative to a wild-type or unmodified CD155 polypeptide. In some embodiments, the variant CD155 polypeptide has a decreased binding affinity for TIGIT and CD226, relative to a wild-type or unmodified CD155 polypeptide. In some embodiments, the variant CD155 polypeptide has a decreased binding affinity for TIGIT and an increased binding affinity for CD226, relative to a wild-type or unmodified CD155 polypeptide.

In some embodiments, the variant CD155 polypeptide has an increased binding affinity for TIGIT and CD96, relative to a wild-type or unmodified CD155 polypeptide. In some embodiments, the variant CD155 polypeptide has an increased binding affinity for TIGIT and a decreased binding affinity for CD96, relative to a wild-type or unmodified CD155 polypeptide. In some embodiments, the variant CD155 polypeptide has a decreased binding affinity for TIGIT and CD96, relative to a wild-type or unmodified CD155 polypeptide. In some embodiments, the variant CD155 polypeptide has a decreased binding affinity for TIGIT and an increased binding affinity for CD96, relative to a wild-type or unmodified CD155 polypeptide.

In some embodiments, the variant CD155 polypeptide has an increased binding affinity for CD226 and CD96, relative to a wild-type or unmodified CD155 polypeptide. In some embodiments, the variant CD155 polypeptide has an increased binding affinity for CD226 and a decreased binding affinity for CD96, relative to a wild-type or unmodified CD155 polypeptide. In some embodiments, the variant CD155 polypeptide has a decreased binding affinity for CD226 and CD96, relative to a wild-type or unmodified CD155 polypeptide. In some embodiments, the variant CD155 polypeptide has a decreased binding affinity for CD226 and an increased binding affinity for CD96, relative to a wild-type or unmodified CD155 polypeptide.

In some embodiments, the variant CD155 polypeptide has an increased binding affinity for TIGIT, CD226, and CD96, relative to a wild-type or unmodified CD155 polypeptide. In some embodiments, the variant CD155 polypeptide has an increased binding affinity for TIGIT and CD226, and a decreased binding affinity for CD96, relative to a wild-type or unmodified CD155 polypeptide. In some embodiments, the variant CD155 polypeptide has an increased binding affinity for TIGIT and CD96, and a decreased binding affinity for CD226, relative to a wild-type or unmodified CD155 polypeptide. In some embodiments, the variant CD155 polypeptide has a decreased binding affinity for TIGIT and CD226, and an increased binding affinity for CD96, relative to a wild-type or unmodified CD155 polypeptide. In some embodiments, the variant CD155 polypeptide has a decreased binding affinity for TIGIT and an increased binding affinity for CD226 and CD96, relative to a wild-type or unmodified CD155 polypeptide. In some embodiments, the variant CD155 polypeptide has an increased binding affinity for TIGIT, and a decreased binding affinity for CD226 and CD96, relative to a wild-type or unmodified CD155 polypeptide. In some embodiments, the variant CD155 polypeptide has a decreased binding affinity for TIGIT, CD96, and CD226, relative to a wild-type or unmodified CD155 polypeptide. In some embodiments, the variant CD155 polypeptide has a decreased binding affinity for TIGIT, and an increased binding affinity for CD226 and CD96, relative to a wild-type or unmodified CD155 polypeptide.

In some embodiments, a variant CD155 polypeptide with increased or greater binding affinity to TIGIT, CD226, and/or CD96 will have an increase in binding affinity relative to the wild-type or unmodified CD155 polypeptide control of at least about 5%, such as at least about 10%, 15%, 20%, 25%, 35%, or 50% for the TIGIT, CD226, and/or CD96. In some embodiments, the increase in binding affinity relative to the wild-type or unmodified CD155 polypeptide is more than 1.2-fold, 1.5-fold, 2-fold, 3-fold, 4-fold, 5-fold, 6-fold, 7-fold, 8-fold, 9-fold, 10-fold, 20-fold, 30-fold 40-fold or 50-fold. In such examples, the wild-type or unmodified CD155 polypeptide has the same sequence as the variant CD155 polypeptide except that it does not contain the one or more amino acid modifications (e.g. substitutions).

In some embodiments, a variant CD155 polypeptide with reduced or decreased binding affinity to TIGIT, CD226, and/or CD96 will have decrease in binding affinity relative to the wild-type or unmodified CD155 polypeptide control of at least 5%, such as at least about 10%, 15%, 20%, 30%, 40%, 50%, 60%, 70%, 80%, 90% or more for the TIGIT, CD226, and/or CD96. In some embodiments, the decrease in binding affinity relative to the wild-type or unmodified CD155 polypeptide is more than 1.2-fold, 1.5-fold, 2-fold, 3-fold, 4-fold, 5-fold, 6-fold, 7-fold, 8-fold, 9-fold, 10-fold, 20-fold, 30-fold 40-fold or 50-fold. In such examples, the wild-type or unmodified CD155 polypeptide has the same sequence as the variant CD155 polypeptide except that it does not contain the one or more amino acid modifications (e.g. substitutions).

In some embodiments, the equilibrium dissociation constant ($K_d$) of any of the foregoing embodiments to TIGIT, CD226, and/or CD96 can be less than $1\times10^{-5}$ M, $1\times10^{-6}$ M, $1\times10^{-7}$ M, $1\times10^{-8}$ M, $1\times10^{-9}$ M, $1\times10^{-10}$ M or $1\times10^{-11}$ M, or $1\times10^{-12}$ M or less.

The wild-type or unmodified CD155 sequence does not necessarily have to be used as a starting composition to generate variant CD155 polypeptides described herein. Therefore, use of the term "modification", such as "substitution" does not imply that the present embodiments are limited to a particular method of making variant CD155 polypeptides. Variant CD155 polypeptides can be made, for example, by de novo peptide synthesis and thus does not necessarily require a modification, such as a "substitution" in the sense of altering a codon to encode for the modification, e.g. substitution. This principle also extends to the terms "addition" and "deletion" of an amino acid residue which likewise do not imply a particular method of making. The means by which the variant CD155 polypeptides are designed or created is not limited to any particular method. In some embodiments, however, a wild-type or unmodified CD155 encoding nucleic acid is mutagenized from wild-type or unmodified CD155 genetic material and screened for desired specific binding affinity and/or induction of IFN-gamma expression or other functional activity. In some embodiments, a variant CD155 polypeptide is synthesized de novo utilizing protein or nucleic acid sequences available at any number of publicly available databases and then subsequently screened. The National Center for Biotechnology Information provides such information and its website is publicly accessible via the internet as is the UniProtKB database as discussed previously.

Unless stated otherwise, as indicated throughout the present disclosure, the amino acid modification(s) are designated by amino acid position number corresponding to the numbering of positions of the unmodified ECD sequence set forth in SEQ ID NO:47 or, where applicable, the unmodified IgV sequence set forth in SEQ ID NO:58 or SEQ ID NO: 155 as follows:

```
                                        (SEQ ID NO: 47)
WPPPGTGDVVVQAPTQVPGFLGDSVTLPCYLQVPNMEVTHVSQLTWARHG

ESGSMAVFHQTQGPSYSESKRLEFVAARLGAELRNASLRMFGLRVEDEGN

YTCLFVTFPQGSRSVDIWLRVLAKPQNTAEVQKVQLTGEPVPMARCVSTG

GRPPAQITWHSDLGGMPNTSQVPGFLSGTVTVTSLWILVPSSQVDGKNVT

CKVEHESFEKPQLLTVNLTVYYPPEVSISGYDNNWYLGQNEATLTCDARS

NPEPTGYNWSTTMGPLPPFAVAQGAQLLIRPVDKPINTTLICNVTNALGA

RQAELTVQVKEGPPSEHSGISRN (SEQ ID NO: 58)
PGTGDVVVQAPTQVPGFLGDSVTLPCYLQVPNMEVTHVSQLTWARHGESG

SMAVFHQTQGPSYSESKRLEFVAARLGAELRNASLRMFGLRVEDEGNYTC

LFVTFPQGSRSVDIWL (SEQ ID NO: 155)
WPPPGTGDVVVQAPTQVPGFLGDSVTLPCYLQVPNMEVTHVSQLTWARHG

ESGSMAVFHQTQGPSYSESKRLEFVAARLGAELRNASLRMFGLRVEDEGN

YTCLFVTFPQGSRSVDIWLRVL
```

It is within the level of a skilled artisan to identify the corresponding position of a modification, e.g. amino acid substitution, in a CD155 polypeptide, including portion thereof containing an IgSF domain (e.g. IgV) thereof, such as by alignment of a reference sequence with SEQ ID NO:47 or SEQ ID NO:58 or SEQ ID NO:155. In the listing of modifications throughout this disclosure, the amino acid position is indicated in the middle, with the corresponding unmodified (e.g. wild-type) amino acid listed before the number and the identified variant amino acid substitution listed after the number. If the modification is a deletion of the position a "del" is indicated and if the modification is an insertion at the position an "ins" is indicated. In some cases, an insertion is listed with the amino acid position indicated in the middle, with the corresponding unmodified (e.g. wild-type) amino acid listed before and after the number and the identified variant amino acid insertion listed after the unmodified (e.g. wild-type) amino acid.

In some embodiments, the variant CD155 polypeptide has one or more amino acid modification, e.g. substitutions in a wild-type or unmodified CD155 sequence. The one or more amino acid modification, e.g. substitutions can be in the ectodomain (extracellular domain) of the wild-type or unmodified CD155 sequence. In some embodiments, the one or more amino acid modification, e.g. substitutions are in the IgV domain or specific binding fragment thereof. In some embodiments, the one or more amino acid modification, e.g. substitutions are in an IgC (e.g. IgC2) domain or specific binding fragment thereof. In some embodiments of the variant CD155 polypeptide, some of the one or more amino acid modification, e.g. substitutions are in the IgV domain or a specific binding fragment thereof, and some of the one or more amino acid modification, e.g. substitutions are in an IgC domain or domains (e.g. IgC2) or a specific binding fragment thereof.

In some embodiments, the variant CD155 polypeptide has up to 1, 2, 3, 4, 5, 6, 7, 8, 9, 10, 11, 12, 13, 14, 15, 16, 17, 18, 19, or 20 amino acid modification, e.g. substitutions. The substitutions can be in the IgV domain or the IgC (e.g. IgC2) domain or domains. In some embodiments, the variant CD155 polypeptide has up to 1, 2, 3, 4, 5, 6, 7, 8, 9, 10, 11, 12, 13, 14, 15, 16, 17, 18, 19, or 20 amino acid modification, e.g. substitutions in the IgV domain or specific binding fragment thereof. In some embodiments, the variant CD155 polypeptide has up to 1, 2, 3, 4, 5, 6, 7, 8, 9, 10, 11, 12, 13, 14, 15, 16, 17, 18, 19, or 20 amino acid modification, e.g. substitutions in the IgC (e.g. IgC2) domain or domains or specific binding fragment thereof. In some embodiments, the variant CD155 polypeptide has at least about 85%, 86%, 86%, 88%, 89%, 90%, 91%, 92%, 93%, 94%, 95%, 96%, 97%, 98%, or 99% sequence identity with the wild-type or unmodified CD155 polypeptide or specific binding fragment thereof, such as with the amino acid sequence of SEQ ID NO: 47, 58 or 155.

In some embodiments, the variant CD155 polypeptide has one or more amino acid modification, e.g. substitutions in an unmodified CD155 or specific binding fragment thereof corresponding to position(s) 7, 8, 9, 10, 11, 12, 13, 15, 16, 18, 19, 20, 21, 22, 23, 24, 25, 26, 29, 30, 32, 33, 34, 35, 36, 37, 38, 39, 40, 41, 42, 44, 45, 46, 47, 48, 49, 50, 51, 52, 53, 54, 55, 56, 57, 58, 59, 60, 61, 62, 64, 65, 67, 68, 69, 70, 72, 73, 75, 76, 77, 78, 79, 80, 81, 82, 83, 84, 85, 87, 88, 89, 90, 91, 92, 94, 95, 96, 97, 98, 99, 100, 102, 104, 106, 107, 108, 110, 111, 112, 113, 114, 115, or 116 with reference to positions set forth in SEQ ID NO: 47. In some embodiments, such variant CD155 polypeptides exhibit altered binding affinity to one or more of TIGIT, CD226, and/or CD96 compared to the wild-type or unmodified CD155 polypeptide. For example, in some embodiments, the variant CD155 polypeptide exhibits increased binding affinity to TIGIT, CD226, and/or CD96 compared to a wild-type or unmodified CD155 polypeptide. In some embodiments, the variant CD155 polypeptide exhibits decreased binding affinity to TIGIT, CD226, or CD96 compared to a wild-type or unmodified CD155 polypeptide.

In some embodiments, the variant CD155 polypeptide has one or more amino acid modifications selected from G7E, D8G, V9A, V9D, V9I, V9L, V10F, V10G, V10I, V11A, V11E, V11M, Q12H, Q12K, Q12L, A13E, A13R, T15I, T15S, Q16H, P18C, P18F, P18H, P18L, P18S, P18T, P18Y, G19D, F20I, F20S, F20Y, L21S, L21M, G22S, D23A, D23G, D23N, D23Y, S24A, S24P, V25A, V25E, T26M, C29R, Y30C, Y30F, Y30H, Q32L, Q32R, V33M, P34S, N35D, N35F, N35S, M36I, M36R, M36T, E37G, E37P, E37S, E37V, V38A, V38G, T39A, T39S, H40Q, H40R, H40T, V41A, V41M, S42A, S42C, S42G, S42L, S42N, S42P, S42Q, S42T, S42V, S42W, L44P, L44V, T45A, T45G, T45I, T45S, T45Q, T45V, W46C, W46R, A47E, A47G, A47V, R48Q, H49L, H49Q, H49R, G50S, E51G, E51K, E51V, S52A, S52E, S52G, S52K, S52L, S52M, S52P, S52Q, S52R, S52T, S52W, G53R, S54C, S54G, S54H, S54N, S54R, M55I, M55L, M55V, A56V, V57A, V57L, V57T, F58L, F58Y, H59E, H59N, N59R, Q60H, Q60K, Q60P, Q60R, T61A, T61G, T61K, T61M, T61R, T61S, Q62F, Q62H, Q62K, Q62L, Q62M, Q62R, Q62Y, P64S, S65A, S65C, S65G, S65D, S65T, S65Y, S65H, S65N, S65T, S65W, S67A, S67E, S67G, S67H, S67L, S67T, S67V, S67W, E68G, S69L, S69P, K70E, K70R, K70Q, L72Q, E73D, E73G, E73R, V75A, V75L, A76E, A76G, A76T, A77T, A77V, R78G, R78K, R78S, L79P, L79Q, L79V, G80D, G80S, A81E, A81P, A81T, A81V, E82D, E82G, L83P, L83Q, R84W, N85D, N85Y, N87T, L88P, R89K, M90I, M90L, M90V, F91S, F91P, F91T, G92A, G92E, G92W, R94H, V95A, E96D, D97G, E98D, E98S, G99D, G99Y, N100Y, T102S, L104E, L104M, L104N, L104P, L104Q, L104T, L104Y, V106A, V106I, V106L, T107A, T107L, T107M, T107S, T107V, F108H, F108L, F108Y, Q110R, G111D, G111R, S112I, S112N, S112V, R113G, R113W, S114N, S114T, V115A, V115M, D116G, or D116N, or a conservative amino acid substitution thereof. A conservative amino acid substitution is any amino acid that falls in the same class of amino acids as the substituted amino acids, other than the wild-type or unmodified amino acid. The classes of amino acids are aliphatic (glycine, alanine, valine, leucine, and isoleucine), hydroxyl or sulfur-containing (serine, cysteine, threonine, and methionine), cyclic (proline), aromatic (phenylalanine, tyrosine, tryptophan), basic (histidine, lysine, and arginine), and acidic/amide (aspartate, glutamate, asparagine, and glutamine).

In some embodiments, the variant CD155 polypeptide has two or more amino acid modifications selected from G7E, D8G, V9A, V9D, V9I, V9L, V10F, V10G, V10I, V11A, V11E, V11M, Q12H, Q12K, Q12L, A13E, A13R, T15I, T15S, Q16H, P18C, P18F, P18H, P18L, P18S, P18T, P18Y, G19D, F20I, F20S, F20Y, L21S, L21M, G22S, D23A, D23G, D23N, D23Y, S24A, S24P, V25A, V25E, T26M, C29R, Y30C, Y30F, Y30H, Q32L, Q32R, V33M, P34S, N35D, N35F, N35S, M36I, M36R, M36T, E37G, E37P, E37S, E37V, V38A, V38G, T39A, T39S, H40Q, H40R, H40T, V41A, V41M, S42A, S42C, S42G, S42L, S42N, S42P, S42Q, S42T, S42V, S42W, L44P, L44V, T45A, T45G, T45I, T45S, T45Q, T45V, W46C, W46R, A47E, A47G, A47V, R48Q, H49L, H49Q, H49R, G50S, E51G, E51K, E51V, S52A, S52E, S52G, S52K, S52L, S52M, S52P, S52Q, S52R, S52T, S52W, G53R, S54C, S54G, S54H, S54N, S54R, M55I, M55L, M55V, A56V, V57A, V57L, V57T, F58L, F58Y, H59E, H59N, N59R, Q60H, Q60K, Q60P, Q60R, T61A, T61G, T61K, T61M, T61R, T61S, Q62F, Q62H, Q62K, Q62L, Q62M, Q62R, Q62Y, P64S, S65A, S65C, S65G, S65D, S65T, S65Y, S65H, S65N, S65T, S65W, S67A, S67E, S67G, S67H, S67L, S67T, S67V, S67W, E68D, E68G, S69L, S69P, K70E, K70R, K70Q, L72Q, E73D, E73G, E73R, V75A, V75L, A76E, A76G, A76T, A77T, A77V, R78G, R78K, R78S, L79P, L79Q, L79V, G80D, G80S, A81E, A81P, A81T, A81V, E82D, E82G, L83P, L83Q, R84W, N85D, N85Y, N87T, L88P, R89K, M90I, M90L, M90V, F91S, F91T, F91P, G92A, G92E, G92W, R94H, V95A, E96D, D97G, E98D, E98S, G99D, G99Y, N100Y, T102S, L104E, L104M, L104N, L104P, L104Q, L104T, L104Y, V106A, V1061, V106L, T107A, T107L, T107M, T107S, T107V, F108H, F108L, F108Y, Q110R, G111D, G111R, S112I, S112N, S112V, R113G, R113W, S114N, S114T, V115A, V115M, D116G, or D116N. In some embodiments, the two or more amino acid modifications is P18S/P64S/F91S, P18S/F91S/L104P, P18L/L79V/F91S, P18S/F91S, P18T/F91S, P18T/S42P/F91S, G7E/P18T/Y30C/F91S, P18T/F91S/G111D, P18S/F91P, P18T/F91S/F108L, P18S/F91S, P18T/T45A/F91S, P18T/F91S/R94H, P18S/Y30C/F91S, A81V/L83P, A13P/P18S/A56V/F91S, P18T/F91S/V115A, P18T/Q60K, S52M, T45Q/S52L/L104E/G111R, S42G, Q62F, S52Q, S42A/L104Q/G111R, S42A/S52Q/L104Q/G111R, S52W/L104E, S42C, S52W, S52M/L104Q, S42L/S52L/Q62F/L104Q, S42W, S42Q, S52L, S52R, L104E, G111R, S52E, Q62Y, T45Q/S52M/L104E, S42N/L104Q/G111R, S52M/V57L, S42N/S52Q/Q62F, S42A/S52L/L104E/G111R, S42W/S52Q/V57L/Q62Y, L104Q, S42L/S52Q/L104E, S42C/S52L, S42W/S52R/Q62Y/L104Q, T45Q/S52R/L104E, S52R/Q62F/L104Q/G111R, T45Q/S52L/V57L/L104E, S52M/Q62Y, Q62F/L104E/G111R, T45Q/S52Q, S52L/L104E, S42V/S52E, T45Q/S52R/G111R, S42G/S52Q/L104E/G111R, S42N/S52E/V57L/L104E, S42C/S52M/Q62F, S42L, S42A, S42G/S52L/Q62F/L104Q, S42N, P18T/S65A/S67V/F91S, P18F/T39A/T45Q/T61R/S65N/S67L/E73G/R78G, P18T/T45Q/T61R/S65N/S67L, P18F/S65A/S67V/F91S, P18F/T45Q/T61R/S65N/S67L/F91S/L104P, P18S/L79P/L104M, P18S/L104M, L79P/L104M, P18T/T45Q/L79P, P18T/T45Q/T61R/S65H/S67H, P18T/A81E, P18S/D23Y/E37P/S52G/Q62M/G80S/A81P/G99Y/S 112N, A13R/D23Y/E37P/S42P/Q62Y/A81E, A13R/D23Y/E37P/G99Y/S112N, A13R/D23Y/E37P/Q62M/A77V/G80S/A81P/G99Y, P18L/E37S/Q62M/G80S/A81P/G99Y/S112N, P18S/L104T, P18S/Q62H/L79Q/F91S, T45Q/S52K/Q62F/L104Q/G111R, T45Q/S52Q/Q62Y/L104Q/G111R, T45Q/S52Q/Q62Y/L104E/G111R, V57A/T61M/S65W/S67A/E96D/L104T, P18L/V57T/T61S/S65Y/S67A/L104T, P18T/T45Q, P18L/V57A/T61M/S65W/S67A/L104T, T61M/S65W/S67A/L104T, P18S/V41A/S42G/T45G/L104N, P18H/S42G/T45I/S52T/G53R/S54H/V57L/H59E/T61S/S65D/E68G/L104N, P18S/S42G/T45V/F58L/S67W/L104N, P18S/T45I/L104N, P18S/S42G/T45G/L104N/V106A, P18H/H40R/S42G/T45I/S52T/G53R/S54H/V57L/H59E/T61S/S65D/E68G/L104Y/V106L/F108H, E37V/S42G/T45G/L104N, P18S/T45Q/L79P/L104T, P18L/Q62R, A13R/D23Y/E37P/S42L/S52G/Q62Y/A81E, P18L/H49R/L104T/D116N, A13R/D23Y/E37P/Q62M/G80S/A81P/L104T, S65T/L104T, A13R/D23Y/E37P/S52G/V57A/Q62M/K70E/L104T, P18L/A47V/Q62Y/E73D/L104T, H40T/V411M/A47V/S52Q/Q62L/S65T/E73R/D97G/E98S/L104T/D116N, P18L/S42P/T45Q/T61G/S65H/S67E/L104T/D116N, P18S/H40T/V41M/A47V/S52Q/Q62L/

S65T/E73R/L104M/V106A, H40T/V41M/A47V/S52Q/Q62L/S65T/E68G/E73R/D97G/E98S/L104T, T45Q/S52E/L104E, T45Q/S52E/Q62F/L104E, P18F/T26M/L44V/Q62K/L79P/F91S/L104M/G111D, P18S/T45S/T61K/S65W/S67A/F91S/G111R, P18S/L79P/L104M/T107M, P18S/S65W/S67A/M90V/V95A/L104Q/G111R, P18S/A47G/L79P/F91S/L104M/T107A/R113W, P18T/D23G/S24A/N35D/H49L/L79P/F91S/L104M/G111R, V9L/P18S/Q60R/V75L/L79P/R89K/F91S/L104E/G111R, P18S/H49R/E73D/L79P/N85D/F91S/V95A/L104M/G111R, V11A/P18S/L79P/F91S/L104M/G111R, V11A/P18S/S54R/Q60P/Q62K/L79P/N85D/F91S/T107M, P18T/S52P/S65A/S67V/L79P/F91S/L104M/G111R, P18T/M36T/L79P/F91S/G111R, D8G/P18S/M36I/V38A/H49Q/A76E/F91S/L104M/T107A/R113W, P18S/S52P/S65A/S67V/L79P/F91S/L104M/T107S/R113W, T15I/P18T/L79P/F91S/L104M/G111R, P18F/T26M/L44V/Q62K/L79P/E82D/F91S/L104M/G111D, P18T/E37G/G53R/Q62K/L79P/F91S/E98D/L104M/T107M, P18L/K70E/L79P/F91S/V95A/G111R, V9I/Q12K/P18F/S65A/S67V/L79P/L104T/G111R/S112I, P18F/S65A/S67V/F91S/L104M/G111R, V9I/V10I/P18S/F20S/T45A/L79P/F91S/L104M/F108Y/G111R/S112V, V9L/P18L/L79P/M90I/F91S/T102S/L104M/G111R, P18C/T26M/L44V/M55I/Q62K/L79P/F91S/L104M/T107M, V9I/P18T/D23G/L79P/F91S/G111R, P18F/L79P/M90L/F91S/V95A/L104M/G111R, P18T/M36T/S65A/S67E/L79Q/A81T/F91S/G111R, V9L/P18T/Q62R/L79P/F91S/L104M/G111R, P18S/S65W/S67A/L104Q/G111R, P18T/G19D/M36T/S54N/L79P/L83Q/F91S/T107M/F108Y, V9L/P18L/M55V/S69L/L79P/A81E/F91S/T107M, P18F/H40Q/T61K/Q62K/L79P/F91S/L104M/T107V, P18S/Q32R/Q62K/R78G/L79P/F91S/T107A/R113W, Q12H/P18T/L21S/G22S/V57A/Q62R/L79P/F91S/T107M, V9I/P18S/S24P/H49Q/F58Y/Q60R/Q62K/L79P/F91S/T107M, P18T/W46C/H49R/S65A/S67V/A76T/L79P/S87T/L104M, P18S/S42T/E51G/L79P/F91S/G92W/T107M, V10F/T15S/P18L/R48Q/L79P/F91S/T107MIV 115M, P18S/L21M/Y30F/N35D/R84W/F91S/T107M/D 116G, P18F/E51V/S54G/Q60R/L79Q/E82G/S87T/M901/F91S/G92R/T107M, Q16H/P18F/F91S/T107M, P18T/D23G/Q60R/S67L/L79P/F91S/T107M/V115A, D8G/V9I/V11A/P18T/T26M/S52P/L79P/F91S/G92A/T107L/V115A, V9I/P18F/A47E/G50S/E68G/L79P/F91S/T107M, P18S/M55I/Q62K/S69P/L79P/F91S/T107M, P18T/T39S/S52P/S54R/L79P/F91S/T107M, P18S/D23N/L79P/F91S/T107M/S114N, P18S/P34S/E51V/L79P/F91S/G111R, P18S/H59N/V75A/L79P/A81T/F91S/L104M/T107M, P18S/W46R/E68D/L79P/F91S/T107M/R113G, V9L/P18F/T45A/S65A/S67V/R78K/L79V/F91S/T107M/S114T, P18T/M55L/T61R/L79P/F91S/V106I/T107M, T15I/P18S/V33M/N35F/T39S/M55L/R78S/L79P/F91S/T107M, P18S/Q62K/K70E/L79P/F91S/G92E/R113W, P18F/F20I/T26M/A47V/E51K/L79P/F91S, P18T/D23A/Q60H/L79P/M90V/F91S/T107M, P18S/D23G/C29R/N35D/E37G/M55I/Q62K/S65A/S67G/R78G/L79P/F91S/L104M/T107M/Q110R, A13E/P18S/M36R/Q62K/S67T/L79P/N85D/F91S/T107M, V9I/P18T/H49R/L79P/N85D/F91S/L104T/T107M, V9A/P18F/T61S/Q62L/L79P/F91S/G111R, D8E/P18T/T61A/L79P/F91S/T107M, P18S/V41A/H49R/S54C/L79S/N85Y/L88P/F91S/L104M/T107M, V 11E/P18H/F20Y/V25E/N35S/H49R/L79P/F91S/T107M/G111R, V11A/P18F/D23A/L79P/G80D/V95A/T107M, P18S/K70R/L79P/F91S/G111R, V9L/V11M/P18S/N35S/S54G/Q62K/L79P/L104M/T107M/V115M, V9L/P18Y/V25A/V38G/M55V/A77T/L79P/M90I/F91S/L104M, V10G/P18T/L72Q/L79P/F91S/T107M, P18S/H59R/A76G/R78S/L79P, V9A/P18S/M36T/S65G/L79P/F91S/L104T/

G111R/S112I, P18T/S52A/V57A/Q60R/Q62K/S65C/L79P/ F91T/N100Y/T107M, V11A/P18F/N35D/A47E/Q62K/ L79P/F91S/G99D/T107M/S114N, V11A/P18T/N35S/ L79P/S87T/F91S, V9D/V11M/Q12L/P18S/E37V/M55I/ Q60R/K70Q/L79P/F91S/L104M/T107M, or T15S/P18S/ Y30H/Q32L/Q62R/L79P/F91S/T107M.

In some embodiments, the variant CD155 polypeptide comprises any of the substitutions (mutations) listed in Table 1. Table 1 also provides exemplary sequences by reference to SEQ ID NO for the extracellular domain (ECD) or IgV domain of wild-type CD155 or exemplary variant CD155 polypeptides. As indicated, the exact locus or residues corresponding to a given domain can vary, such as depending on the methods used to identify or classify the domain. Also, in some cases, adjacent N- and/or C-terminal amino acids of a given domain (e.g. IgV) also can be included in a sequence of a variant IgSF polypeptide, such as to ensure proper folding of the domain when expressed. Thus, it is understood that the exemplification of the SEQ ID NOSs in Table 1 is not to be construed as limiting. For example, the particular domain, such as the IgV domain, of a variant CD155 polypeptide can be several amino acids longer or shorter, such as 1-10, e.g. 1, 2, 3, 4, 5, 6 or 7 amino acids longer or shorter, than the sequence of amino acids set forth in the respective SEQ ID NO. In some embodiments, the variant CD155 polypeptide comprises any of the mutations listed in Table 1. In some embodiments, the variant CD155 polypeptide comprises any of the extracellular domain (ECD) sequences listed in Table 1 (i.e., any one of SEQ ID NOS: 59-80, 178-274, 1230-1252, 1269, and 1610-1655). In some embodiments, the variant CD155 polypeptide comprises a polypeptide sequence that exhibits at least 90% identity, at least 91% identity, at least 92% identity, at least 93% identity, at least 94% identity, at least 95% identity, such as at least 96% identity, 97% identity, 98% identity, or 99% identity to any of the extracellular domain (ECD) sequences listed in Table 1 (i.e., any one of SEQ ID NOS: 59-80, 178-274, 1230-1252, 1269, and 1610-1655) and contains the amino acid modification(s), e.g. substitution(s) not present in the wild-type or unmodified CD155. In some embodiments, the variant CD155 polypeptide comprises a specific binding fragment of any of the extracellular domain (ECD) sequences listed in Table 1 (i.e., any one of SEQ ID NOS: 59-80, 178-274, 1230-1252, 1269, and 1610-1655) and contains the amino acid modification(s), e.g. substitution(s) not present in the wild-type or unmodified CD155. In some embodiments, the variant CD155 polypeptide comprises any of the IgV sequences listed in Table 1 (i.e., any one of SEQ ID NOS: 81-102, 156-177, 275-468, 1184-1229, 1270-1271, 1656-1747). In some embodiments, the variant CD155 polypeptide comprises a polypeptide sequence that exhibits at least 90% identity, at least 91% identity, at least 92% identity, at least 93% identity, at least 94% identity, at least 95% identity, such as at least 96% identity, 97% identity, 98% identity, or 99% identity to any of the IgV sequences listed in Table 1 (i.e., any one of SEQ ID NOS: 81-102, 156-177, 275-468, 1184-1229, 1270-1271, 1656-1747) and contains the amino acid modification(s), e.g. substitution(s) not present in the wild-type or unmodified CD155. In some embodiments, the variant CD155 polypeptide comprises a specific binding fragment of any of the IgV sequences listed in Table 1 (i.e., any one of SEQ ID NOS: 81-102, 156-177, 275-468, 1184-1229, 1270-1271, 1656-1747) and contains the amino acid modification(s), e.g. substitution(s) not present in the wild-type or unmodified CD155.

TABLE 1

| Exemplary variant CD155 polypeptides | | |
| --- | --- | --- |
| Mutation(s) | ECD SEQ ID NO | IgV SEQ ID NO |
| Wild-type | 47 | 58, 155 |
| P18S, P64S, F91S | 59 | 81, 156 |
| P18S, F91S, L104P | 60 | 82, 157 |
| L44P | 61 | 83, 158 |
| A56V | 62 | 84, 159 |
| P18L, L79V, F91S | 63 | 85, 160 |
| P18S, F91S | 64 | 86, 161 |
| P18T, F91S | 65 | 87, 162 |
| P18T, S42P, F91S | 66 | 88, 163 |
| G7E, P18T, Y30C, F91S | 67 | 89, 164 |
| P18T, F91S, G111D | 68 | 90,165 |
| P18S, F91P | 69 | 91, 166 |
| P18T, F91S, F108L | 70 | 92, 167 |
| P18T, T45A, F91S | 72 | 94, 169 |
| P18T, F91S, R94H | 73 | 95, 170 |
| P18S, Y30C, F91S | 74 | 96, 171 |
| A81V, L83P | 75 | 97, 172 |
| L88P | 76 | 98, 173 |
| R94H | 77 | 99, 174 |
| A13E, P18S, A56V, F91S | 78 | 100, 175 |
| P18T, F91S, V115A | 79 | 101, 176 |
| P18T, Q60K | 80 | 102, 177 |
| S52M | 178 | 275, 372 |
| T45Q, S52L, L104E, G111R | 179 | 276, 373 |
| S42G | 180 | 277, 374 |
| Q62F | 181 | 278, 375 |
| S52Q | 182 | 279, 376 |
| S42A, L104Q, G111R | 183 | 280, 377 |
| S42A, S52Q, L104Q, G111R | 184 | 281, 378 |
| S52W, L104E | 185 | 282, 379 |
| S42C | 186 | 283, 380 |
| S52W | 187 | 284, 381 |
| S52M, L104Q | 188 | 285, 382 |
| S42L, S52L, Q62F, L104Q | 189 | 286, 383 |
| S42W | 190 | 287, 384 |
| S42Q | 191 | 288, 385 |
| S52L | 192 | 289, 386 |
| S52R | 193 | 290, 387 |
| L104E | 194 | 291, 388 |
| G111R | 195 | 292, 389 |
| S52E | 196 | 293, 390 |
| Q62Y | 197 | 294, 391 |
| T45Q, S52M, L104E | 198 | 295, 392 |
| S42N, L104Q, G111R | 199 | 296, 393 |
| S52M, V57L | 200 | 297, 394 |
| S42N, S52Q, Q62F | 201 | 298, 395 |
| S42A, S52L, L104E, G111R | 202 | 299, 396 |
| S42W, S52Q, V57L, Q62Y | 203 | 300, 397 |
| L104Q | 204 | 301, 398 |
| S42L, S52Q, L104E | 205 | 302, 399 |
| S42C, S52L | 206 | 303, 400 |
| S42W, S52R, Q62Y, L104Q | 207 | 304, 401 |
| T45Q, S52R, L104E | 208 | 305, 402 |
| S52R, Q62F, L104Q, G111R | 209 | 306, 403 |
| T45Q, S52L, V57L, L104E | 210 | 307, 404 |
| S52M, Q62Y | 211 | 308, 405 |
| Q62F, L104E, G111R | 212 | 309, 406 |
| T45Q, S52Q | 213 | 310, 407 |
| S52L, L104E | 214 | 311, 408 |
| S42V, S52E | 215 | 312, 409 |
| T45Q, S52R, G111R | 216 | 313, 410 |
| S42G, S52Q, L104E, G111R | 217 | 314, 411 |
| S42N, S52E, V57L, L104E | 218 | 315, 412 |
| S42C, S52M, Q62F | 219 | 316, 413 |
| S42L | 220 | 317, 414 |
| S42A | 221 | 318, 415 |
| S42G, S52L, Q62F, L104Q | 222 | 319, 416 |
| S42N | 223 | 320, 417 |
| P18T, S65A, S67V, F91S | 224 | 321, 418 |
| P18F, T39A, T45Q, T61R, S65N, S67L, E73G, R78G | 225 | 322, 419 |
| P18T, T45Q, T61R, S65N, S67L | 226 | 323, 420 |
| P18F, S65A, S67V, F91S | 227 | 324, 421 |

TABLE 1-continued

Exemplary variant CD155 polypeptides

| Mutation(s) | ECD SEQ ID NO | IgV SEQ ID NO |
|---|---|---|
| P18F, T45Q, T61R, S65N, S67L, F91S, L104P | 228 | 325, 422 |
| P18S, L79P, L104M | 229 | 326, 423 |
| P18S, L104M | 230 | 327, 424 |
| L79P, L104M | 231 | 328, 425 |
| P18T, T45Q, L79P | 232 | 329, 426 |
| P18T, T45Q, T61R, S65H, S67H | 233 | 330, 427 |
| P18T, A81E | 234 | 331, 428 |
| P18S, D23Y, E37P, S52G, Q62M, G80S, A81P, G99Y, S112N | 235 | 332, 429 |
| A13R, D23Y, E37P, S42P, Q62Y, A81E | 236 | 333, 430 |
| A13R, D23Y, E37P, G99Y, S112N | 237 | 334, 431 |
| A13R, D23Y, E37P, Q62M, A77V, G80S, A81P, G99Y | 238 | 335, 432 |
| P18L, E37S, Q62M, G80S, A81P, G99Y, S112N | 239 | 336, 433 |
| P18S, L104T | 240 | 337, 434 |
| P18S, Q62H, L79Q, F91S | 241 | 338, 435 |
| T45Q, S52K, Q62F, L104Q, G111R | 242 | 339, 436 |
| T45Q, S52Q, Q62Y, L104Q, G111R | 243 | 340, 437 |
| T45Q, S52Q, Q62Y, L104E, G111R | 244 | 341, 438 |
| V57A, T61M, S65W, S67A, E96D, L104T | 245 | 342, 439 |
| P18L, V57T, T61S, S65Y, S67A, L104T | 246 | 343, 440 |
| P18T, T45Q | 247 | 344, 441 |
| P18L, V57A, T61M, S65W, S67A, L104T | 248 | 345, 442 |
| T61M, S65W, S67A, L104T | 249 | 346, 443 |
| P18S, V41A, S42G, T45G, L104N | 250 | 347, 444 |
| P18H, S42G, T45I, S52T, G53R, S54H, V57L, H59E, T61S, S65D, E68G, L104N | 251 | 348, 445 |
| P18S, S42G, T45V, F58L, S67W, L104N | 252 | 349, 446 |
| P18S, T45I, L104N | 253 | 350, 447 |
| P18S, S42G, T45G, L104N, V106A | 254 | 351, 448 |
| P18H, H40R, S42G, T45I, S52T, G53R, S54H, V57L, H59E, T61S, S65D, E68G, L104Y, V106L, F108H | 255 | 352, 449 |
| E37V, S42G, T45G, L104N | 256 | 353, 450 |
| P18S, T45Q, L79P, L104T | 257 | 354, 451 |
| P18L, Q62R | 258 | 355, 452 |
| A13R, D23Y, E37P, S42L, S52G, Q62Y, A81E | 259 | 356, 453 |
| P18L, H49R, L104T, D116N | 260 | 357, 454 |
| A13R, D23Y, E37P, Q62M, G80S, A81P, L104T | 261 | 358, 455 |
| S65T, L104T | 262 | 359, 456 |
| A13R, D23Y, E37P, S52G, V57A, Q62M, K70E, L104T | 263 | 360, 457 |
| P18L, A47V, Q62Y, E73D, L104T | 264 | 361, 458 |
| H40T, V41M, A47V, S52Q, Q62L, S65T, E73R, D97G, E98S, L104T, D116N | 265 | 362, 459 |
| P18L, S42P, T45Q, T61G, S65H, S67E, L104T, D116N | 266 | 363, 460 |
| P18S, H40T, V41M, A47V, S52Q, Q62L, S65T, E73R, L104M, V106A | 267 | 364, 461 |
| H40T, V41M, A47V, S52Q, Q62L, S65T, E68G, E73R, D97G, E98S, L104T | 268 | 365, 462 |
| T45Q, S52E, L104E | 269 | 366, 463 |
| T45Q, S52E, Q62F, L104E | 270 | 367, 464 |
| P18F, T26M, L44V, Q62K, L79P, F91S, L104M, G111D | 271 | 368, 465 |
| P18S, T45S, T61K, S65W, S67A, F91S, G111R | 272 | 369, 466 |
| P18S, L79P, L104M, T107M | 273 | 370, 467 |
| P18S, S65W, S67A, M90V, V95A, L104Q, G111R | 274 | 371, 468 |
| P18S, A47G, L79P, F91S, L104M, T107A, R113W | 1230 | 1184, 1207 |
| P18T, D23G, S24A, N35D, H49L, L79P, F91S, L104M, G111R | 1231 | 1185, 1208 |
| V9L, P18S, Q60R, V75L, L79P, R89K, F91S, L104E, G111R | 1232 | 1186, 1209 |
| P18S, H49R, E73D, L79P, N85D, F91S, V95A, L104M, G111R | 1233 | 1187, 1210 |
| V11A, P18S, L79P, F91S, L104M, G111R | 1234 | 1188, 1211 |
| V11A, P18S, S54R, Q60P, Q62K, L79P, N85D, F91S, T107M | 1235 | 1189, 1212 |
| P18T, S52P, S65A, S67V, L79P, F91S, L104M, G111R | 1236 | 1190, 1213 |

TABLE 1-continued

Exemplary variant CD155 polypeptides

| Mutation(s) | ECD SEQ ID NO | IgV SEQ ID NO |
|---|---|---|
| P18T, M36T, L79P, F91S, G111R | 1237 | 1191, 1214 |
| D8G, P18S, M36I, V38A, H49Q, A76E, F91S, L104M, T107A, R113W | 1238 | 1192, 1215 |
| P18S, S52P, S65A, S67V, L79P, F91S, L104M, T107S, R113W | 1239 | 1193, 1216 |
| T15I, P18T, L79P, F91S, L104M, G111R | 1240 | 1194, 1217 |
| P18F, T26M, L44V, Q62K, L79P, E82D, F91S, L104M, G111D | 1241 | 1195, 1218 |
| P18T, E37G, G53R, Q62K, L79P, F91S, E98D, L104M, T107M | 1242 | 1196, 1219 |
| P18L, K70E, L79P, F91S, V95A, G111R | 1243 | 1197, 1220 |
| V9I, Q12K, P18F, S65A, S67V, L79P, L104T, G111R, S112I | 1244 | 1198, 1221 |
| P18F, S65A, S67V, F91S, L104M, G111R | 1245 | 1199, 1222 |
| V9I, V10I, P18S, F20S, T45A, L79P, F91S, L104M, F108Y, G111R, S112V | 1246 | 1200, 1223 |
| V9L, P18L, L79P, M90I, F91S, T102S, L104M, G111R | 1247 | 1201, 1224 |
| P18C, T26M, L44V, M55I, Q62K, L79P, F91S, L104M, T107M | 1248 | 1202, 1225 |
| V9I, P18T, D23G, L79P, F91S, G111R | 1249 | 1203, 1226 |
| P18F, L79P, M90L, F91S, V95A, L104M, G111R | 1250 | 1204, 1227 |
| P18T, M36T, S65A, S67E, L79Q, A81T, F91S, G111R | 1251 | 1205, 1228 |
| V9L, P18T, Q62R, L79P, F91S, L104M, G111R | 1252 | 1206, 1229 |
| P18S, S65W, S67A, L104Q, G111R | 1269 | 1270, 1271 |
| P18T, G19D, M36T, S54N, L79P, L83Q, F91S, T107M, F108Y | 1610 | 1656, 1702 |
| V9L, P18L, M55V, S69L, L79P, A81E, F91S, T107M | 1611 | 1657, 1703 |
| P18F, H40Q, T61K, Q62K, L79P, F91S, L104M, T107V | 1612 | 1658, 1704 |
| P18S, Q32R, Q62K, R78G, L79P, F91S, T107A, R113W | 1613 | 1659, 1705 |
| Q12H, P18T, L21S, G22S, V57A, Q62R, L79P, F91S, T107M | 1614 | 1660, 1706 |
| V9I, P18S, S24P, H49Q, F58Y, Q60R, Q62K, L79P, F91S, T107M | 1615 | 1661, 1707 |
| P18T, W46C, H49R, S65A, S67V, A76T, L79P, S87T, L104M | 1616 | 1662, 1708 |
| P18S, S42T, E51G, L79P, F91S, G92W, T107M | 1617 | 1663, 1709 |
| V10F, T15S, P18L, R48Q, L79P, F91S, T107M, V115M | 1618 | 1664, 1710 |
| P18S, L21M, Y30F, N35D, R84W, F91S, T107M, D116G | 1619 | 1665, 1711 |
| P18F, E51V, S54G, Q60R, L79Q, E82G, S87T, M90I, F91S, G92R, T107M | 1620 | 1666, 1712 |
| Q16H, P18F, F91S, T107M | 1621 | 1667, 1713 |
| P18T, D23G, Q60R, S67L, L79P, F91S, T107M, V115A | 1622 | 1668, 1714 |
| D8G, V9I, V11A, P18T, T26M, S52P, L79P, F91S, G92A, T107L, V115A | 1623 | 1669, 1715 |
| V9I, P18F, A47E, G50S, E68G, L79P, F91S, T107M | 1624 | 1670, 1716 |
| P18S, M55I, Q62K, S69P, L79P, F91S, T107M | 1625 | 1671, 1717 |
| P18T, T39S, S52P, S54R, L79P, F91S, T107M | 1626 | 1672, 1718 |
| P18S, D23N, L79P, F91S, T107M, S114N | 1627 | 1673, 1719 |
| P18S, P34S, E51V, L79P, F91S, G111R | 1628 | 1674, 1720 |
| P18S, H59N, V75A, L79P, A81T, F91S, L104M, T107M | 1629 | 1675, 1721 |
| P18S, W46R, E68D, L79P, F91S, T107M, R113G | 1630 | 1676, 1722 |
| V9L, P18F, T45A, S65A, S67V, R78K, L79V, F91S, T107M, S114T | 1631 | 1677, 1723 |
| P18T, M55L, T61R, L79P, F91S, V106I, T107M | 1632 | 1678, 1724 |
| T15I, P18S, V33M, N35F, T39S, M55L, R78S, L79P, F91S, T107M | 1633 | 1679, 1725 |
| P18S, Q62K, K70E, L79P, F91S, G92E, R113W | 1634 | 1680, 1726 |
| P18F, F20I, T26M, A47V, E51K, L79P, F91S | 1635 | 1681, 1727 |
| P18T, D23A, Q60H, L79P, M90V, F91S, T107M | 1636 | 1682, 1728 |
| P18S, D23G, C29R, N35D, E37G, M55I, Q62K, S65A, S67G, R78G, L79P, F91S, L104M, T107M, Q110R | 1637 | 1683, 1729 |

TABLE 1-continued

Exemplary variant CD155 polypeptides

| Mutation(s) | ECD SEQ ID NO | IgV SEQ ID NO |
|---|---|---|
| A13E, P18S, M36R, Q62K, S67T, L79P, N85D, F91S, T107M | 1638 | 1684, 1730 |
| V9I, P18T, H49R, L79P, N85D, F91S, L104T, T107M | 1639 | 1685, 1731 |
| V9A, P18F, T61S, Q62L, L79P, F91S, G111R | 1640 | 1686, 1732 |
| D8E, P18T, T61A, L79P, F91S, T107M | 1641 | 1687, 1733 |
| P18S, V41A, H49R, S54C, L79S, N85Y, L88P, F91S, L104M, T107M | 1642 | 1688, 1734 |
| V11E, P18H, F20Y, V25E, N35S, H49R, L79P, F91S, T107M, G111R | 1643 | 1689, 1735 |
| V11A, P18F, D23A, L79P, G80D, V95A, T107M | 1644 | 1690, 1736 |
| P18S, K70R, L79P, F91S, G111R | 1645 | 1691, 1737 |
| V9L, V11M, P18S, N35S, S54G, Q62K, L79P, L104M, T107M, | 1646 | 1692, 1738 |
| V9L, P18Y, V25A, V38G, M55V, A77T, L79P, M90I, F91S, L104M | 1647 | 1693, 1739 |
| V10G, P18T, L72Q, L79P, F91S, T107M | 1648 | 1694, 1740 |
| P18S, H59R, A76G, R78S, L79P | 1649 | 1695, 1741 |
| V9A, P18S, M36T, S65G, L79P, F91S, L104T, G111R, S112I | 1650 | 1696, 1742 |
| P18T, S52A, V57A, Q60R, Q62K, S65C, L79P, F91T, N100Y, T107M | 1651 | 1697, 1743 |
| V11A, P18F, N35D, A47E, Q62K, L79P, F91S, G99D, T107M, S114N | 1652 | 1698, 1744 |
| V11A, P18T, N35S, L79P, S87T, F91S | 1653 | 1699, 1745 |
| V9D, V11M, Q12L, P18S, E37V, M55I, Q60R, K70Q, L79P, F91S, L104M, T107M | 1654 | 1700, 1746 |
| T15S, P18S, Y30H, Q32L, Q62R, L79P, F91S, T107M | 1655 | 1701, 1747 |

In some embodiments, the variant CD155 polypeptide exhibits increased affinity for the ectodomain of TIGIT compared to the wild-type or unmodified CD155 polypeptide, such as comprising the sequence set forth in SEQ ID NO: 47, 58 or 155. In some embodiments, the CD155 polypeptide exhibits increased affinity for the ectodomain of CD226 compared to the wild-type or unmodified CD155, such as comprising the sequence set forth in SEQ ID NO: 47, 58 or 155. In some embodiments, the CD155 polypeptide exhibits increased affinity for the ectodomain of CD96 compared to the wild-type or unmodified CD155, such as comprising the sequence set forth in SEQ ID NO: 47, 58 or 155. In some embodiments, the CD155 polypeptide exhibits increased affinity for the ectodomain of TIGIT, the ectodomain of CD226, and the ectodomain of CD96 compared to the wild-type or unmodified CD155, such as comprising the sequence set forth in SEQ ID NO: 47, 58 or 155. In some embodiments, the CD155 polypeptide exhibits increased affinity for the ectodomain of TIGIT and the ectodomain of CD226 compared to the wild-type or unmodified CD155, such as comprising the sequence set forth in SEQ ID NO: 47, 58 or 155. In some embodiments, the CD155 polypeptide exhibits increased affinity for the ectodomain of TIGIT and the ectodomain of CD96 compared to the wild-type or unmodified CD155, such as comprising the sequence set forth in SEQ ID NO: 47, 58 or 155. In some embodiments, the CD155 polypeptide exhibits increased affinity for the ectodomain of CD226 and the ectodomain of CD96 compared to the wild-type or unmodified CD155, such as comprising the sequence set forth in SEQ ID NO: 47, 58 or 155.

In some embodiments, the variant CD155 polypeptide exhibits increased binding affinity for binding one of the ectodomains of TIGIT, CD226, or CD96 and exhibits decreased binding affinity for binding to the other of the ectodomains of TIGIT, CD226, or CD96 compared to the wild-type or unmodified CD155 polypeptide, such as comprising the sequence set forth in SEQ ID NO: 47, 58 or 155. In some embodiments, the variant CD155 polypeptide exhibits increased affinity for the ectodomain of TIGIT or the ectodomain of CD226, and decreased affinity for the ectodomain of CD96, compared to wild-type or unmodified CD155 polypeptide, such as comprising the sequence set forth in SEQ ID NO: 47, 58 or 155. In some embodiments, the variant CD155 polypeptide exhibits increased affinity for the ectodomain of TIGIT or the ectodomain of CD96, and decreased affinity for the ectodomain of CD226, compared to wild-type or unmodified CD155 polypeptide, such as comprising the sequence set forth in SEQ ID NO: 47, 58 or 155. In some embodiments, the variant CD155 polypeptide exhibits increased affinity for the ectodomain of CD226 or the ectodomain of CD96, and decreased affinity for the ectodomain of TIGIT, compared to wild-type or unmodified CD155 polypeptide, such as comprising the sequence set forth in SEQ ID NO: 47, 58 or 155.

In some embodiments, the variant CD155 polypeptide exhibits increased affinity for the ectodomain of TIGIT and the ectodomain of CD226, and decreased affinity for the ectodomain of CD96, compared to wild-type or unmodified CD155 polypeptide, such as comprising the sequence set forth in SEQ ID NO: 47, 58 or 155. In some embodiments, the variant CD155 polypeptide exhibits increased affinity for the ectodomain of TIGIT and the ectodomain of CD96, and decreased affinity for the ectodomain of CD226, compared to wild-type or unmodified CD155 polypeptide, such as comprising the sequence set forth in SEQ ID NO: 47, 58 or 155. In some embodiments, the variant CD155 polypeptide exhibits increased affinity for the ectodomain of CD226 and the ectodomain of CD96, and decreased affinity for the ectodomain of TIGIT, compared to wild-type or unmodified CD155 polypeptide, such as comprising the sequence set forth in SEQ ID NO: 47, 58 or 155.

In some embodiments, the variant CD155 polypeptide exhibits increased affinity for the ectodomain of TIGIT, and decreased affinity for the ectodomain of CD226 and the ectodomain of CD96, compared to wild-type or unmodified CD155 polypeptide, such as comprising the sequence set forth in SEQ ID NO: 47, 58 or 155. In some embodiments, the variant CD155 polypeptide exhibits increased affinity for the ectodomain of CD96, and decreased affinity for the ectodomain of TIGIT and the ectodomain of CD226, compared to wild-type or unmodified CD155 polypeptide, such as comprising the sequence set forth in SEQ ID NO: 47, 58 or 155. In some embodiments, the variant CD155 polypeptide exhibits increased affinity for the ectodomain of CD226, and decreased affinity for the ectodomain of TIGIT and the ectodomain of CD96, compared to wild-type or unmodified CD155 polypeptide, such as comprising the sequence set forth in SEQ ID NO: 47, 58 or 155.

In some embodiments, a variant CD155 polypeptide exhibits increased selectivity for TIGIT versus CD226 compared to the ratio of binding of the unmodified CD155 polypeptide (e.g. set forth in SEQ ID NO:47, 58 or 155) for TIGIT versus CD226, such as indicated by a ratio of TIGIT binding to CD226 binding (TIGIT:CD226 binding ratio) that is greater than 1. In some embodiments, the variant CD155 polypeptide exhibits a ratio of binding to TIGIT versus CD226 that is greater than or greater than about or 1.1, 1.2, 1.3, 1.4, 1.5, 2, 3, 4, 5, 6, 7, 8, 9, 10, 11, 12, 13, 14, 15, 16, 17, 18, 19, 20, 21, 22, 23, 24, 25, 26, 27, 28, 29, 30, 35, 40, 45, 50, 55, 60, 65, 70, or more.

III. Format of Variant Polypeptides

The immunomodulatory polypeptide comprising a variant CD155 provided herein in which is contained a vIgD can be formatted in a variety of ways, including as a soluble protein, membrane bound protein or secreted protein. In some embodiments, the particular format can be chosen for the desired therapeutic application. In some cases, an immunomodulatory polypeptide comprising a variant CD155 polypeptide is provided in a format to antagonize or block activity of its cognate binding partner, e.g. TIGIT. In some embodiments, antagonism of TIGIT may be useful to promote immunity in oncology. In some cases, an immunomodulatory polypeptide comprising a variant CD155 polypeptide is provided in a format to agonize or stimulate activity of its cognate binding partner, e.g. TIGIT. In some embodiments, agonism of TIGIT may be useful for treating inflammation or autoimmunity. A skilled artisan can readily determine the activity of a particular format, such as for antagonizing or agonizing one or more specific cognate binding partner. Exemplary methods for assessing such activities are provided herein, including in the examples.

In some aspects, provided are immunomodulatory proteins comprising a vIgD of CD155 in which such proteins are soluble, e.g. fused to an Fc chain. In some aspects, one or more additional IgSF domain, such as one or more additional vIgD, may be linked to a vIgD of CD155 as provided herein (hereinafter called a "stack" or "stacked" immunomodulatory protein). In some embodiments, the modular format of the provided immunomodulatory proteins provides flexibility for engineering or generating immunomodulatory proteins for modulating activity of multiple counterstructures (multiple cognate binding partners). In some embodiments, such "stack" molecules can be provided in a soluble format or, in some cases, may be provided as membrane bound or secreted proteins. In some embodiments, a variant CD155 immunomodulatory protein is provided as a conjugate in which is contained a vIgD of CD155 linked, directly or indirectly, to a targeting agent or moiety, e.g. to an antibody or other binding molecules that specifically binds to a ligand, e.g. an antigen, for example, for targeting or localizing the vIgD to a specific environment or cell, such as when administered to a subject. In some embodiments, the targeting agent, e.g. antibody or other binding molecule, binds to a tumor antigen, thereby localizing the variant CD155 containing the vIgD to the tumor microenvironment, for example, to modulate activity of tumor infiltrating lymphocytes (TILs) specific to the tumor microenvironment.

In some embodiments, provided immunomodulatory proteins are expressed in cells and provided as part of an engineered cellular therapy (ECT). In some embodiments, the variant CD155 polypeptide is expressed in a cell, such as an immune cell (e.g. T cell or antigen presenting cell), in membrane-bound form, thereby providing a transmembrane immunomodulatory protein (hereinafter also called a "TIP"). In some embodiments, depending on the cognate binding partner recognized by the TIP, engineered cells expressing a TIP can agonize a cognate binding partner by providing a costimulatory signal, either positive to negative, to other engineered cells and/or to endogenous T cells. In some aspects, the variant CD155 polypeptide is expressed in a cell, such as an immune cell (e.g. T cell or antigen presenting cell), in secretable form to thereby produce a secreted or soluble form of the variant CD155 polypeptide (hereinafter also called a "SIP"), such as when the cells are administered to a subject. In some aspects, a SIP can antagonize a cognate binding partner in the environment (e.g. tumor microenvironment) in which it is secreted. In some embodiments, a variant CD155 polypeptide is expressed in an infectious agent (e.g. viral or bacterial agent) which, upon administration to a subject, is able to infect a cell in vivo, such as an immune cell (e.g. T cell or antigen presenting cell), for delivery or expression of the variant polypeptide as a TIP or a SIP in the cell.

In some embodiments, a soluble immunomodulatory polypeptide, such as a variant CD155 containing a vIgD, can be encapsulated within a liposome which itself can be conjugated to any one of or any combination of the provided conjugates (e.g., a targeting moiety). In some embodiments, the soluble or membrane bound immunomodulatory polypeptides of the invention are deglycosylated. In more specific embodiments, the variant CD155 sequence is deglycosylated. In even more specific embodiments, the IgV and/or IgC (e.g. IgC2) domain or domains of the variant CD155 is deglycosylated.

Figure 1B:
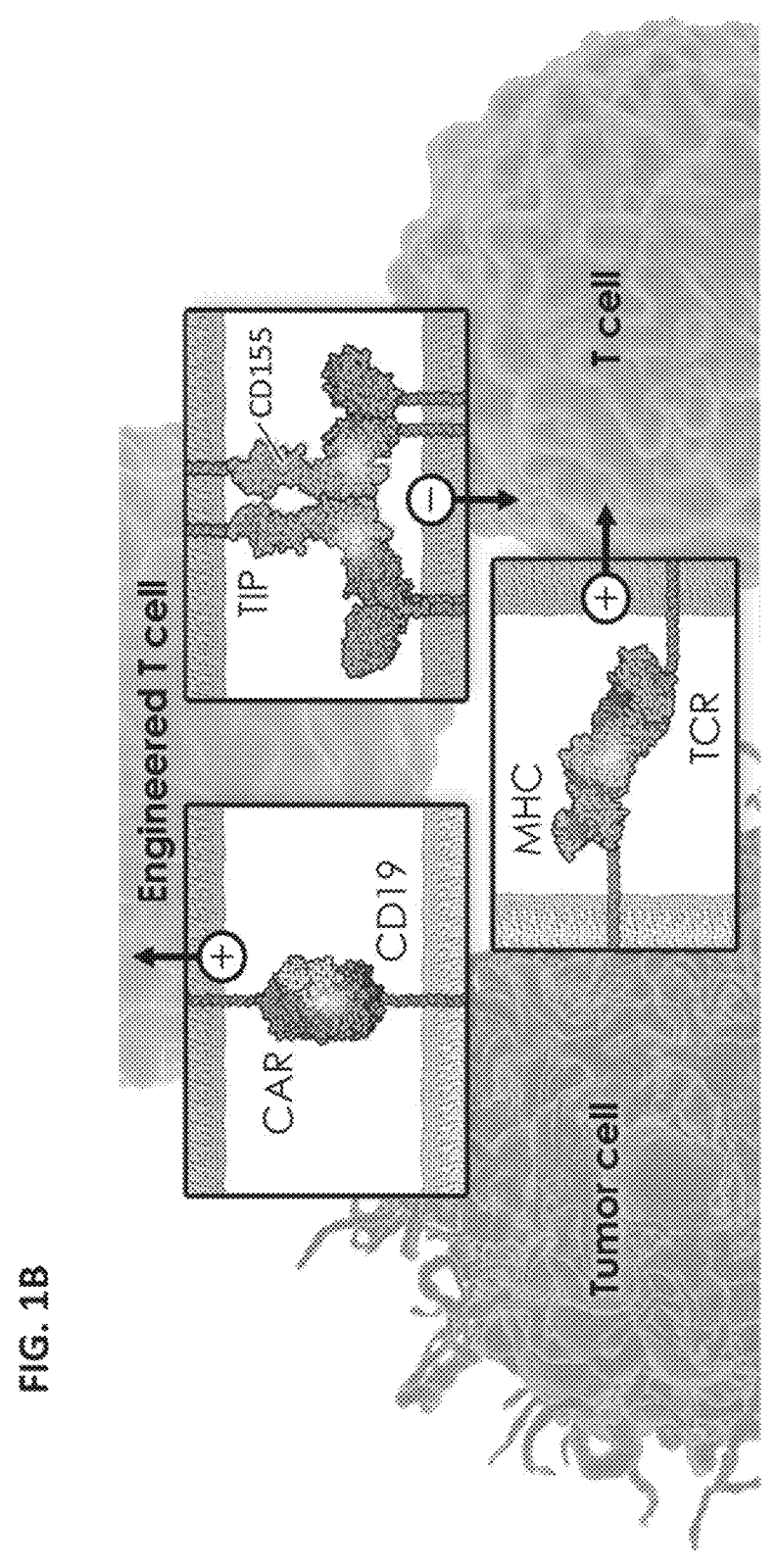
Figure 1C:
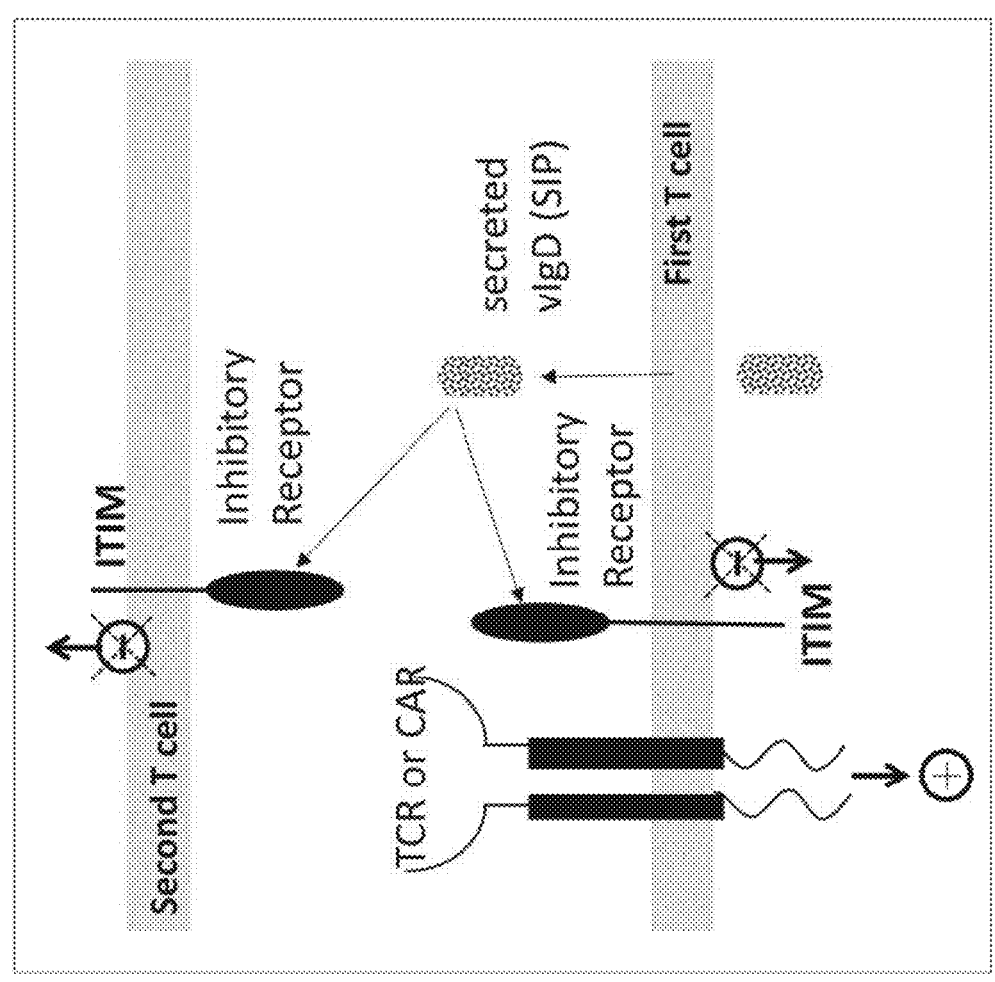
Figure 2:
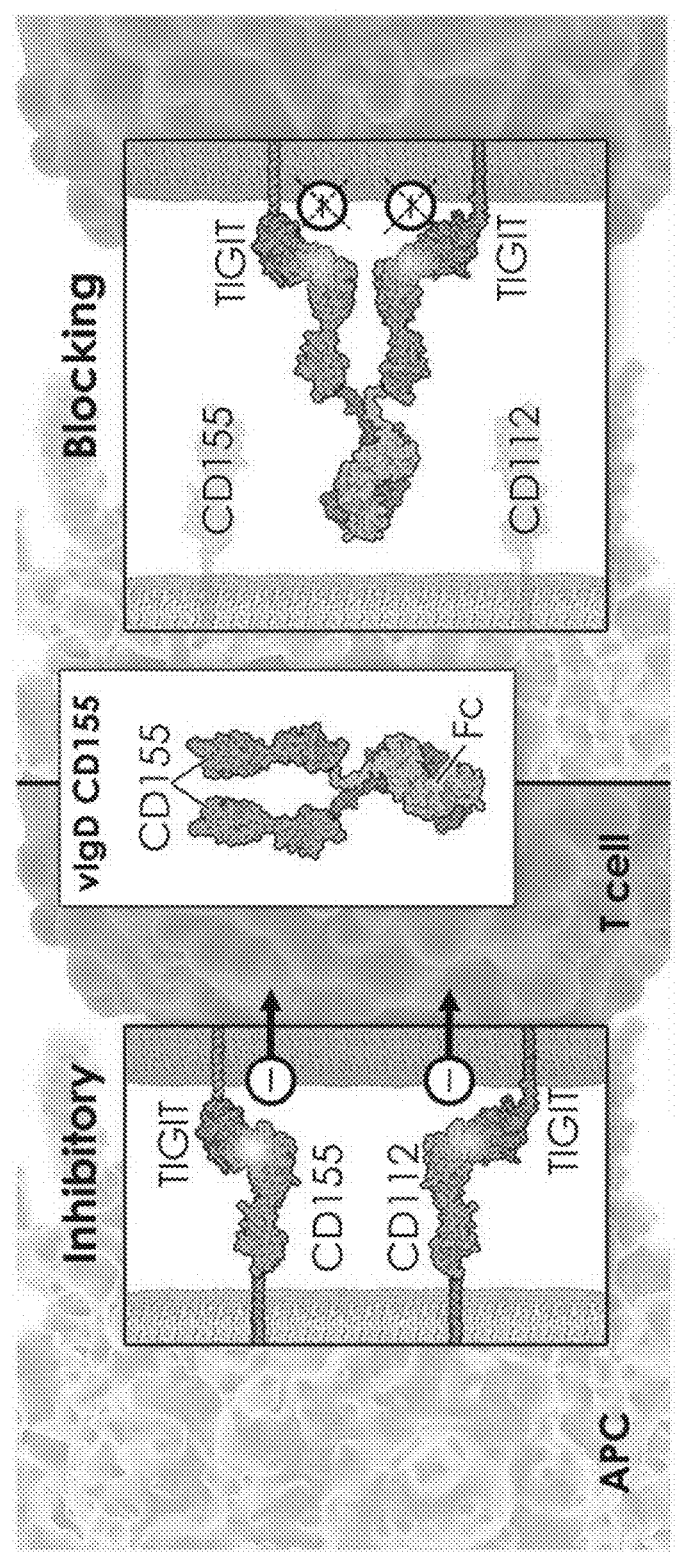
FIG. 2 depicts an exemplary schematic of the activity of a variant IgSF domain (vIgD) fused to an Fc (vIgD-Fc) in which the vIgD is a variant of an IgSF domain of CD155. As shown, a soluble vIgD of CD155 interacts with its cognate binding partners to block interactions of CD155 or CD112 with TIGIT, thereby blocking the TIGIT inhibitory receptor, and, in some cases, allowing the T cell to differentiate into an effector phenotype.
Figure 3:
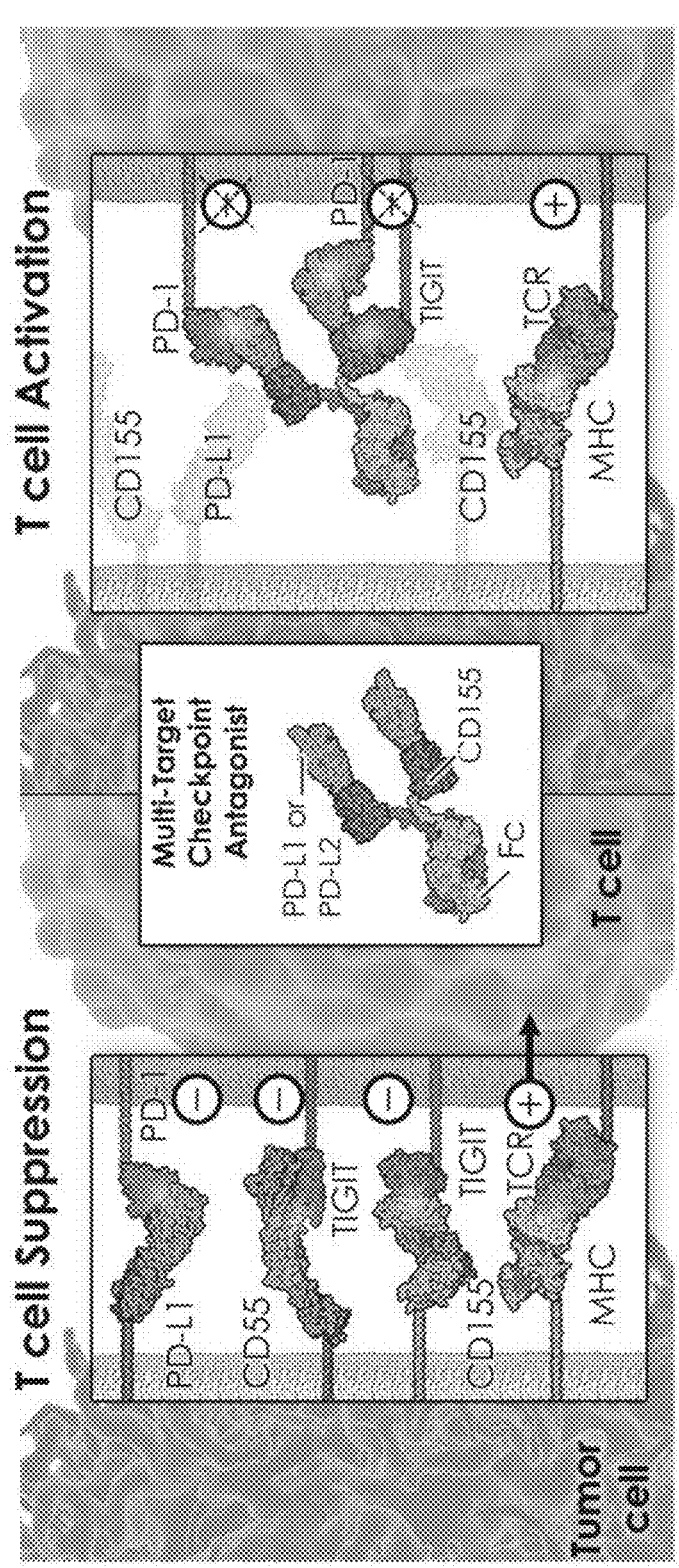
FIG. 3 depicts an exemplary schematic of a stack mol-ecule that is a multi-target checkpoint antagonist containing a first variant IgSF domain (first vIgD) that is a PD-L1 or PD-L2 vIgD and a second IgSF domain (e.g. a second vIgD) that binds to a second inhibitory receptor. In the exemplary schematic, the second IgSF domain (e.g. second vIgD) is a CD155 vIgD. As shown, the first vIgD and second vIgD interact with their cognate binding partners to block inter-actions of PD-L1 or PD-L2 with PD-1 and block interactions of CD155 with TIGIT, respectively, blocking multiple inhibitory receptors.
Figure 4:
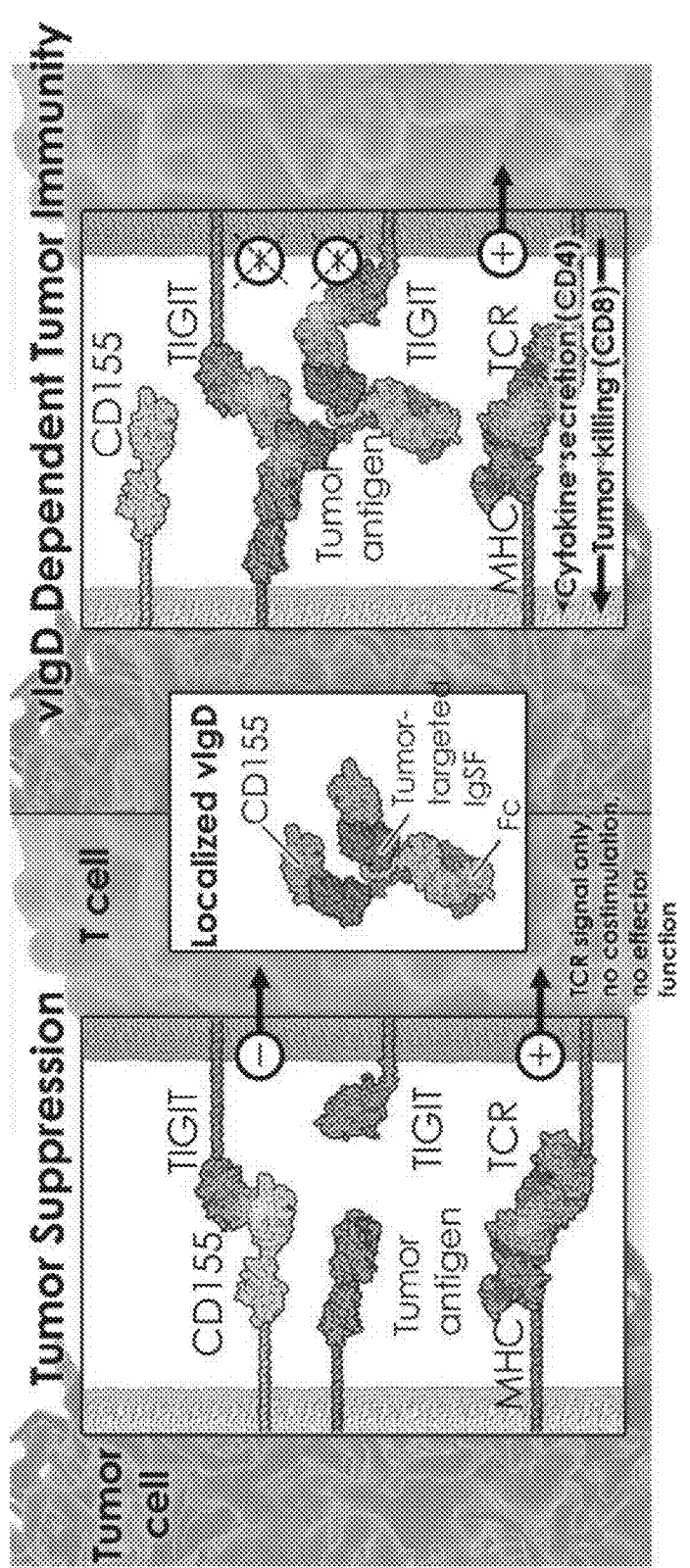
FIG. 4 depicts an exemplary schematic of a stack mol-ecule for localizing the variant IgSF (vIgD) to a tumor cell. In this format, the stack molecule contains a first variant IgSF domain (first vIgD) and a second IgSF domain (e.g. a second vIgD) in which the second IgSF domain (e.g a second vIgD) is a tumor-targeted IgSF domain that binds to a tumor antigen. An exemplary tumor-targeted IgSF domain is an IgSF domain of NKp30, which binds to the tumor antigen B7-H6. In this depiction, the variant IgSF domain (vIgD) is a variant of an IgSF domain of CD155. As shown, binding of tumor-targeted IgSF domain to the surface of the tumor cell localizes the first variant IgSF domain on the tumor cell surface where it can interact with one or more of its cognate binding partners expressed on the surface of an adjacent immune cell (e.g. T cell) to antagonize the inhibi-tory signal of TIGIT.

Non-limiting examples of provided formats are described in FIGS. 1A-1C and further described below.

A. Soluble Protein

In some embodiments, the immunomodulatory protein containing a variant CD155 polypeptide is a soluble protein. Those of skill will appreciate that cell surface proteins typically have an intracellular, transmembrane, and extracellular domain (ECD) and that a soluble form of such proteins can be made using the extracellular domain or an immunologically active subsequence thereof. Thus, in some embodiments, the immunomodulatory protein containing a variant CD155 polypeptide lacks a transmembrane domain or a portion of the transmembrane domain. In some embodiments, the immunomodulatory protein containing a variant CD155 lacks the intracellular (cytoplasmic) domain or a portion of the intracellular domain. In some embodiments, the immunomodulatory protein containing the variant CD155 polypeptide only contains the vIgD portion containing the ECD domain or a portion thereof containing an IgV domain and/or IgC (e.g. IgC2) domain or domains or specific binding fragments thereof containing the amino acid modification(s).

In some embodiments, an immunomodulatory polypeptide comprising a variant CD155 can include one or more variant CD155 polypeptides of the invention. In some embodiments a polypeptide of the invention will comprise exactly 1, 2, 3, 4, 5 variant CD155 sequences. In some embodiments, at least two of the variant CD155 sequences are identical variant CD155 sequences.

In some embodiments, the provided immunomodulatory polypeptide comprises two or more vIgD sequences of CD155. Multiple variant CD155 polypeptides within the polypeptide chain can be identical (i.e., the same species) to each other or be non-identical (i.e., different species) variant CD155 sequences. In addition to single polypeptide chain embodiments, in some embodiments two, three, four, or more of the polypeptides of the invention can be covalently or non-covalently attached to each other. Thus, monomeric, dimeric, and higher order (e.g., 3, 4, 5, or more) multimeric proteins are provided herein. For example, in some embodiments exactly two polypeptides of the invention can be covalently or non-covalently attached to each other to form a dimer. In some embodiments, attachment is made via interchain cysteine disulfide bonds. Compositions comprising two or more polypeptides of the invention can be of an identical species or substantially identical species of polypeptide (e.g., a homodimer) or of non-identical species of polypeptides (e.g., a heterodimer). A composition having a plurality of linked polypeptides of the invention can, as noted above, have one or more identical or non-identical variant CD155 polypeptides of the invention in each polypeptide chain.

In some embodiments, the immunomodulatory protein comprises a variant CD155 polypeptide attached to an immunoglobulin Fc (yielding an "immunomodulatory Fc fusion," such as a "CD155-Fc variant fusion," also termed a CD155 vIgD-Fc fusion). In some embodiments, the attachment of the variant CD155 polypeptide is at the N-terminus of the Fc. In some embodiments, the attachment of the variant CD155 polypeptide is at the C-terminus of the Fc. In some embodiments, two or more CD155 variant polypeptides (the same or different) are independently attached at the N-terminus and at the C-terminus.

In some embodiments, the Fc is murine or human Fc. In some embodiments, the Fc is a mammalian or human IgG1, IgG2, IgG3, or IgG4 Fc regions. In some embodiments, the Fc is derived from IgG1, such as human IgG1. In some embodiments, the Fc comprises the amino acid sequence set forth in SEQ ID NO: 56 or a sequence of amino acids that exhibits at least 85%, 86%, 87%, 88%, 89%, 90%, 91%, 92%, 93%, 94%, 95%, 96%, 97%, 98%, 99% or more sequence identity to SEQ ID NO: 56.

In some embodiments, the Fc region contains one more modifications to alter (e.g. reduce) one or more of its normal functions. In general, the Fc region is responsible for effector functions, such as complement-dependent cytotoxicity (CDC) and antibody-dependent cell cytotoxicity (ADCC), in addition to the antigen-binding capacity, which is the main function of immunoglobulins. Additionally, the FcRn sequence present in the Fc region plays the role of regulating the IgG level in serum by increasing the in vivo half-life by conjugation to an in vivo FcRn receptor. In some embodiments, such functions can be reduced or altered in an Fc for use with the provided Fc fusion proteins.

In some embodiments, one or more amino acid modifications may be introduced into the Fc region of a CD155-Fc variant fusion provided herein, thereby generating an Fc region variant. In some embodiments, the Fc region variant has decreased effector function. There are many examples of changes or mutations to Fc sequences that can alter effector function. For example, WO 00/42072, WO2006019447, WO2012125850, WO2015/107026, US2016/0017041 and Shields et al. J Biol. Chem. 9(2): 6591-6604 (2001) describe exemplary Fc variants with improved or diminished binding to FcRs. The contents of those publications are specifically incorporated herein by reference.

In some embodiments, the provided variant CD155-Fc fusions comprise an Fc region that exhibits reduced effector functions, which makes it a desirable candidate for applications in which the half-life of the CD155-Fc variant fusion in vivo is important yet certain effector functions (such as CDC and ADCC) are unnecessary or deleterious. In vitro and/or in vivo cytotoxicity assays can be conducted to confirm the reduction/depletion of CDC and/or ADCC activities. For example, Fc receptor (FcR) binding assays can be conducted to ensure that the CD155-Fc variant fusion lacks FcγR binding (hence likely lacking ADCC activity), but retains FcRn binding ability. The primary cells for mediating ADCC, NK cells, express FcγRIII only, whereas monocytes express FcγRI, FcγRII and FcγRIII. FcR expression on hematopoietic cells is summarized in Table 3 on page 464 of Ravetch and Kinet, *Annu. Rev. Immunol.* 9:457-492 (1991). Non-limiting examples of in vitro assays to assess ADCC activity of a molecule of interest is described in U.S. Pat. No. 5,500,362 (see, e.g. Hellstrom, I.

et al. Proc. Nat'l Acad. Sci. USA 83:7059-7063 (1986)) and Hellstrom, I et al., Proc. Nat'l Acad. Sci. USA 82:1499-1502 (1985); U.S. Pat. No. 5,821,337 (see Bruggemann, M. et al., J. Exp. Med. 166:1351-1361 (1987)). Alternatively, non-radioactive assay methods may be employed (see, for example, ACTI™ non-radioactive cytotoxicity assay for flow cytometry (Cell Technology, Inc. Mountain View, Calif; and CytoTox 96™ non-radioactive cytotoxicity assay (Promega, Madison, Wis.). Useful effector cells for such assays include peripheral blood mononuclear cells (PBMC) and Natural Killer (NK) cells. Alternatively, or additionally, ADCC activity of the molecule of interest may be assessed in vivo, e.g., in an animal model such as that disclosed in Clynes et al. *Proc. Nat'l Acad. Sci. USA* 95:652-656 (1998). C1q binding assays may also be carried out to confirm that the CD155-Fc variant fusion is unable to bind C1q and hence lacks CDC activity. See, e.g., C1q and C3c binding ELISA in WO 2006/029879 and WO 2005/100402. To assess complement activation, a CDC assay may be performed (see, for example, Gazzano-Santoro et al., *J. Immunol. Methods* 202:163 (1996); Cragg, M. S. et al., *Blood* 101:1045-1052 (2003); and Cragg, M. S. and M. J. Glennie, Blood 103:2738-2743 (2004)). FcRn binding and in vivo clearance/half life determinations can also be performed using methods known in the art (see, e.g., Petkova, S. B. et al., *Int'l. Immunol.* 18(12):1759-1769 (2006)).

CD155-Fc variant fusions with reduced effector function include those with substitution of one or more of Fc region residues 238, 265, 269, 270, 297, 327 and 329 by EU numbering (U.S. Pat. No. 6,737,056). Such Fc mutants include Fc mutants with substitutions at two or more of amino acid positions 265, 269, 270, 297 and 327 by EU numbering, including the so-called "DANA" Fc mutant with substitution of residues 265 and 297 to alanine (U.S. Pat. No. 7,332,581).

In some embodiments, the Fc region of CD155-Fc variant fusions has an Fc region in which any one or more of amino acids at positions 234, 235, 236, 237, 238, 239, 270, 297, 298, 325, and 329 (indicated by EU numbering) are substituted with different amino acids compared to the native Fc region. Such alterations of Fc region are not limited to the above-described alterations, and include, for example, alterations such as deglycosylated chains (N297A and N297Q), IgG1-N297G, IgG1-L234A/L235A, IgG1-L234A/L235E/G237A, IgG1-A325A/A330S/P331S, IgG1-C226S/C229S, IgG1-C226S/C229S/E233P/L234V/L235A, IgG1-E233P/L234V/L235A/G236del/S267K, IgG1-L234F/L235E/P331S, IgG1-S267E/L328F, IgG2-V234A/G237A, IgG2-H268Q/V309L/A330S/A331S, IgG4-L235A/G237A/E318A, and IgG4-L236E described in Current Opinion in Biotechnology (2009) 20 (6), 685-691; alterations such as G236R/L328R, L235G/G236R, N325A/L328R, and N325LL328R described in WO 2008/092117; amino acid insertions at positions 233, 234, 235, and 237 (indicated by EU numbering); and alterations at the sites described in WO 2000/042072.

Certain Fc variants with improved or diminished binding to FcRs are described. (See, e.g., U.S. Pat. No. 6,737,056; WO 2004/056312, WO2006019447 and Shields et al., *J. Biol. Chem.* 9(2): 6591-6604 (2001).)

In some embodiments, there is provided a CD155-Fc variant fusion comprising a variant Fc region comprising one or more amino acid substitutions which increase half-life and/or improve binding to the neonatal Fc receptor (FcRn). Antibodies with increased half-lives and improved binding to FcRn are described in US2005/0014934A1 (Hinton et al.) or WO2015107026. Those antibodies comprise an Fc region with one or more substitutions therein which improve binding of the Fc region to FcRn. Such Fc variants include those with substitutions at one or more of Fc region residues: 238, 256, 265, 272, 286, 303, 305, 307, 311, 312, 317, 340, 356, 360, 362, 376, 378, 380, 382, 413, 424 or 434 by EU numbering, e.g., substitution of Fc region residue 434 (U.S. Pat. No. 7,371,826).

In some embodiments, the Fc region of a CD155-Fc variant fusion comprises one or more amino acid substitution E356D and M358L by EU numbering. In some embodiments, the Fc region of a CD155-Fc variant fusion comprises one or more amino acid substitutions C220S, C226S and/or C229S by EU numbering. In some embodiments, the Fc region of a CD155 variant fusion comprises one or more amino acid substitutions R292C and V302C. See also Duncan & Winter, *Nature* 322:738-40 (1988); U.S. Pat. Nos. 5,648,260; 5,624,821; and WO 94/29351 concerning other examples of Fc region variants.

In some embodiments, alterations are made in the Fc region that result in diminished C1q binding and/or Complement Dependent Cytotoxicity (CDC), e.g., as described in U.S. Pat. No. 6,194,551, WO 99/51642, and Idusogie et al., J. Immunol. 164: 4178-4184 (2000).

In some embodiments, there is provided a CD155-Fc variant fusion comprising a variant Fc region comprising one or more amino acid modifications, wherein the variant Fc region is derived from IgG1, such as human IgG1. In some embodiments, the variant Fc region is derived from the amino acid sequence set forth in SEQ ID NO: 56. In some embodiments, the Fc contains at least one amino acid substitution that is N82G by numbering of SEQ ID NO: 56 (corresponding to N297G by EU numbering). In some embodiments, the Fc further contains at least one amino acid substitution that is R77C or V87C by numbering of SEQ ID NO: 56 (corresponding to R292C or V302C by EU numbering). In some embodiments, the variant Fc region further comprises a C5S amino acid modification by numbering of SEQ ID NO: 56 (corresponding to C220S by EU numbering). For example, in some embodiments, the variant Fc region comprises the following amino acid modifications: V297G and one or more of the following amino acid modifications C220S, R292C or V302C by EU numbering (corresponding to N82G and one or more of the following amino acid modifications C5S, R77C or V87C with reference to SEQ ID NO:56), e.g. the Fc region comprises the sequence set forth in SEQ ID NO:1135. In some embodiments, the variant Fc region comprises one or more of the amino acid modifications C220S, L234A, L235E or G237A, e.g. the Fc region comprises the sequence set forth in SEQ ID NO:1136. In some embodiments, the variant Fc region comprises one or more of the amino acid modifications C220S, L235P, L234V, L235A, G236del or S267K, e.g. the Fc region comprises the sequence set forth in SEQ ID NO:1137. In some embodiments, the variant Fc comprises one or more of the amino acid modifications C220S, L234A, L235E, G237A, E356D or M358L, e.g. the Fc region comprises the sequence set forth in SEQ ID NO:1119.

In some embodiments, the Fc region lacks the C-terminal lysine corresponding to position 232 of the wild-type or unmodified Fc set forth in SEQ ID NO: 56 (corresponding to K447del by EU numbering). In some aspects, such an Fc region can additionally include one or more additional modifications, e.g. amino acid substitutions, such as any as described. Exemplary of such an Fc region is set forth in SEQ ID NO:1253, 1748, 1749 or 1750.

In some embodiments, there is provided a CD155-Fc variant fusion comprising a variant Fc region in which the variant Fc comprises the sequence of amino acids set forth in any of SEQ ID NOS:1119, 1135, 1136, 1137, 1253, 1748, 1749, or 1750 or a sequence of amino acids that exhibits at least 85%, 86%, 87%, 88%, 89%, 90%, 91%, 92%, 93%, 94%, 95%, 96%, 97%, 98%, 99% or more sequence identity to any of SEQ ID NOS: 1119, 1135, 1136, 1137, 1253, 1748, 1749, or 1750.

In some embodiments, the Fe is derived from IgG2, such as human IgG2. In some embodiments, the Fc comprises the amino acid sequence set forth in SEQ ID NO: 57 or a sequence of amino acids that exhibits at least 85%, 86%, 87%, 88%, 89%, 90%, 91%, 92%, 93%, 94%, 95%, 96%, 97%, 98%, 99% or more sequence identity to SEQ ID NO: 57.

In some embodiments, the Fc comprises the amino acid sequence of human IgG4 set forth in SEQ ID NO: 1178 or a sequence of amino acids that exhibits at least 85%, 86%, 87%, 88%, 89%, 90%, 91%, 92%, 93%, 94%, 95%, 96%, 97%, 98%, 99% or more sequence identity to SEQ ID NO:1178. In some embodiments, the IgG4 Fc is a stabilized Fc in which the CH3 domain of human IgG4 is substituted with the CH3 domain of human IgG1 and which exhibits inhibited aggregate formation, an antibody in which the CH3 and CH2 domains of human IgG4 are substituted with the CH3 and CH2 domains of human IgG1, respectively, or an antibody in which arginine at position 409 indicated in the EU index proposed by Kabat et al. of human IgG4 is substituted with lysine and which exhibits inhibited aggregate formation (see e.g. U.S. Pat. No. 8,911,726. In some embodiments, the Fc is an IgG4 containing the S228P mutation, which has been shown to prevent recombination between a therapeutic antibody and an endogenous IgG4 by Fab-arm exchange (see e.g. Labrijin et al. (2009) Nat. Biotechnol., 27(8):767-71.) In some embodiments, the Fc comprises the amino acid sequence set forth in human IgG4 with S228P set forth in SEQ ID NO: 1179 or a sequence of amino acids that exhibits at least 85%, 86%, 87%, 88%, 89%, 90%, 91%, 92%, 93%, 94%, 95%, 96%, 97%, 98%, 99% or more sequence identity to SEQ ID NO:1179.

In some embodiments, the variant CD155 polypeptide is directly linked to the Fc sequence. In some embodiments, the variant CD155 polypeptide is indirectly linked to the Fc sequence, such as via a linker. In some embodiments, one or more "peptide linkers" link the variant CD155 polypeptide and the Fc domain. In some embodiments, a peptide linker can be a single amino acid residue or greater in length. In some embodiments, the peptide linker has at least one amino acid residue but is no more than 20, 19, 18, 17, 16, 15, 14, 13, 12, 11, 10, 9, 8, 7, 6, 5, 4, 3, 2, or 1 amino acid residues in length. In some embodiments, the linker is three alanines (AAA). In some embodiments, the linker is (in one-letter amino acid code): GGGGS ("4GS"; SEQ ID NO:1752) or multimers of the 4GS linker, such as repeats of 2, 3, 4, or 5 4GS linkers, such as set forth in SEQ ID NO: 1182 (2×GGGGS) or SEQ ID NO: 1181 (3×GGGGS). In some embodiments, the linker (in one-letter amino acid code) is GSGGGGS (SEQ ID NO:1751).

In some embodiments, the variant CD155-Fc fusion protein is a dimer formed by two variant CD155 Fc polypeptides linked to an Fe domain. In some embodiments, the dimer is a homodimer in which the two variant CD155 Fc polypeptides are the same. In some embodiments, the dimer is a heterodimer in which the two variant CD155 Fc polypeptides are different.

Also provided are nucleic acid molecules encoding the variant CD155-Fc fusion protein. In some embodiments, for production of an Fc fusion protein, a nucleic acid molecule encoding a variant CD155-Fc fusion protein is inserted into an appropriate expression vector. The resulting variant CD155-Fc fusion protein can be expressed in host cells transformed with the expression where assembly between Fc domains occurs by interchain disulfide bonds formed between the Fc moieties to yield dimeric, such as divalent, variant CD155-Fc fusion proteins.

The resulting Fc fusion proteins can be easily purified by affinity chromatography over Protein A or Protein G columns. For the generation of heterodimers, additional steps for purification can be necessary. For example, where two nucleic acids encoding different variant CD155 polypeptides are transformed into cells, the formation of heterodimers must be biochemically achieved since variant CD155 molecules carrying the Fc-domain will be expressed as disulfide-linked homodimers as well. Thus, homodimers can be reduced under conditions that favor the disruption of interchain disulfides, but do no effect intra-chain disulfides. In some cases, different variant-CD155 Fc monomers are mixed in equimolar amounts and oxidized to form a mixture of homo- and heterodimers. The components of this mixture are separated by chromatographic techniques. Alternatively, the formation of this type of heterodimer can be biased by genetically engineering and expressing Fc fusion molecules that contain a variant CD155 polypeptide using knob-into-hole methods described below.

B. Stack Molecules with Additional IgSF Domains

In some embodiments, the immunomodulatory proteins can contain any of the variant CD155 polypeptides provided herein linked, directly or indirectly, to one or more other immunoglobulin superfamily (IgSF) domain ("stacked" immunomodulatory protein construct and also called a "Type II" immunomodulatory protein). In some aspects, this can create unique multi-domain immunomodulatory proteins that bind two or more, such as three or more, cognate binding partners, thereby providing a multi-targeting modulation of the immune synapse.

In some embodiments, an immunomodulatory protein comprises a combination (a "non-wild-type combination") and/or arrangement (a "non-wild type arrangement" or "non-wild-type permutation") of a variant CD155 domain with one or more other affinity modified and/or non-affinity modified IgSF domain sequences of another IgSF family member (e.g. a mammalian IgSF family member) that are not found in wild-type IgSF family members. In some embodiments, the immunomodulatory protein contains 2, 3, 4, 5 or 6 immunoglobulin superfamily (IgSF) domains, where at least one of the IgSF domain is a variant CD155 IgSF domain (vIgD of CD155) according to the provided description.

In some embodiments, the sequences of the additional IgSF domains can be a modified IgSF domain that contains one or more amino acid modifications, e.g. substitutions, compared to a wildtype or unmodified IgSF domain. In some embodiments, the IgSF domain can be non-affinity modified (e.g., wild-type) or have been affinity modified. In some embodiments, the unmodified or wild-type IgSF domain can be from mouse, rat, cynomolgus monkey, or human origin, or combinations thereof. In some embodiments, the additional IgSF domains can be an IgSF domain of an IgSF family member set forth in Table 2. In some embodiments, the additional IgSF domain can be an affinity-modified IgSF domain containing one or more amino acid modifications, e.g. substitutions, compared to an IgSF domain contained in an IgSF family member set forth in Table 2.

In some embodiments, the additional IgSF domain is an affinity or non-affinity modified IgSF domain contained in an IgSF family member of a family selected from Signal-Regulatory Protein (SIRP) Family, Triggering Receptor Expressed On Myeloid Cells Like (TREML) Family, Carcinoembryonic Antigen-related Cell Adhesion Molecule (CEACAM) Family, Sialic Acid Binding Ig-Like Lectin (SIGLEC) Family, Butyrophilin Family, B7 family, CD28 family, V-set and Immunoglobulin Domain Containing (VSIG) family, V-set transmembrane Domain (VSTM) family, Major Histocompatibility Complex (MHC) family, Signaling lymphocytic activation molecule (SLAM) family, Leukocyte immunoglobulin-like receptor (LIR), Nectin (Nec) family, Nectin-like (NECL) family, Poliovirus receptor related (PVR) family, Natural cytotoxicity triggering receptor (NCR) family, T cell immunoglobulin and mucin (TIM) family or Killer-cell immunoglobulin-like receptors (KIR) family. In some embodiments, the additional IgSF domains are independently derived from an IgSF protein selected from the group consisting of CD80(B7-1), CD86 (B7-2), CD274 (CD155, B7-H1), PDCD1LG2(CD155, CD273), ICOSLG(B7RP1, CD275, ICOSL, B7-H2), CD276(B7-H3), VTCN1(B7-H4), CD28, CTLA4, PDCD1 (TIGIT), ICOS, BTLA(CD272), CD4, CD8A(CD8-alpha), CD8B(CD8-beta), LAG3, HAVCR2(TIM-3), CEACAM1, TIGIT, PVR(CD155), PVRL2(CD112), CD226, CD2, CD160, CD200, CD200R1(CD200R), and NCR3 (NKp30).

The first column of Table 2 provides the name and, optionally, the name of some possible synonyms for that particular IgSF member. The second column provides the protein identifier of the UniProtKB database, a publicly available database accessible via the internet at uniprot.org or, in some cases, the GenBank Number. The Universal Protein Resource (UniProt) is a comprehensive resource for protein sequence and annotation data. The UniProt databases include the UniProt Knowledgebase (UniProtKB). UniProt is a collaboration between the European Bioinformatics Institute (EMBL-EBI), the SIB Swiss Institute of Bioinformatics and the Protein Information Resource (PIR) and supported mainly by a grant from the U.S. National Institutes of Health (NIH). GenBank is the NIH genetic sequence database, an annotated collection of all publicly available DNA sequences (Nucleic Acids Research, 2013 January; 41(D1):D36-42). The third column provides the region where the indicated IgSF domain is located. The region is specified as a range where the domain is inclusive of the residues defining the range. Column 3 also indicates the IgSF domain class for the specified IgSF region. Column 4 provides the region where the indicated additional domains are located (signal peptide, S; extracellular domain, E; transmembrane domain, T; cytoplasmic domain, C). It is understood that description of domains can vary depending on the methods used to identify or classify the domain, and may be identified differently from different sources. The description of residues corresponding to a domain in Table 2 is for exemplification only and can be several amino acids (such as one, two, three or four) longer or shorter. Column 5 indicates for some of the listed IgSF members, some of its cognate cell surface binding partners.

TABLE 2

| IgSF Member (Synonyms) | NCBI Protein Accession Number/ UniProtKB Protein Identifier | IgSF Region & Domain Class | Other Domains | Cognate Cell Surface Binding Partners | IgSF Member Amino Acid Sequence (SEQ ID NO) Precursor (mature residues) | Mature | ECD |
|---|---|---|---|---|---|---|---|
| IgSF members according to the present disclosure. | | | | | | | |
| CD80 (B7-1) | NP_005182.1 P33681 | 35-135, 35-138, or 35-14137-138 IgV, 145-230 or 154-232 IgC | S: 1-34, E: 35-242, T: 243-263, C: 264-288 | CD28, CTLA4, PD-L1 | 1 (35-288) | 103 | 28 |
| CD86 (B7-2) | P42081.2 | 33-131 IgV, 150-225 IgC2 | S: 1-23, E: 24-247, T: 248-268, C: 269-329 | CD28, CTLA4 | 2 (24-329) | 104 | 29 |
| CD274 (PD-L1, B7-H1) | Q9NZQ7.1 | 19-127, 24-130 IgV, 133-225 IgC2 | S: 1-18, E: 19-238, T: 239-259, C: 260-290 | PD-1, B7-1 | 3 (19-290) | 105 | 30 |
| PDCD1LG2 (PD-L2, CD273) | Q9BQ51.2 | 21-118 IgV, 122-203 IgC2 | S: 1-19, E: 20-220, T: 221-241, C: 242-273 | PD-1, RGMb | 4 (20-273) | 106 | 31 |
| ICOSLG (B7RP1, CD275, ICOSL, B7-H2) | O75144.2 | 19-129 IgV, 141-227 IgC2 | S: 1-18, E: 19-256, T: 257-277, C: 278-302 | ICOS, CD28, CTLA4 | 5 (19-302) | 107 | 32 |
| CD276 (B7-H3) | Q5ZPR3.1 | 29-139 IgV, 145-238 IgC2, 243-357 IgV2, 367-453, 363-456 IgC2 | S: 1-28, E: 29-466, T: 467-487, C: 488-534 | | 6 (29-534) | 108 | 33 |
| VTCN1 (B7-H4) | Q7Z7D3.1 | 35-146 IgV, 153-241 IgV | S: 1-24, E: 25-259, T: 260-280, C: 281-282 | | 7 (25-282) | 109 | 34 |
| CD28 | P10747.1 | 28-137 IgV | S: 1-18, E: 19-152, T: 153-179, C: 180-220 | B7-1, B7-2, B7RP1 | 8 (19-220) | 110 | 35 |
| CTLA4 | P16410.3 | 39-140 IgV | S: 1-35, E: 36-161, T: 162-182, C: 183-223 | B7-1, B7-2, B7RP1 | 9 (36-223) | 111 | 36 |
| PDCD1 (PD-1) | Q15116.3 | 35-145 IgV | S: 1-20, E: 21-170, T: 171-191, C: 192-288 | PD-L1, PD-L2 | 10 (21-288) | 112 | 37 |
| ICOS | Q9Y6W8.1 | 30-132 IgV | S: 1-20, E: 21-140, T: 141-161, C: 162-199 | B7RP1 | 11 (21-199) | 113 | 38 |
| BTLA (CD272) | Q7Z6A9.3 | 31-132 IgV | S: 1-30, E: 31-157, T: 158-178, C: 179-289 | HVEM | 12 (31-289) | 114 | 39 |
| CD4 | P01730.1 | 26-125 IgV, 126-203 IgC2, 204-317 IgC2, 317-389, 318-374 IgC2 | S: 1-25, E: 26-396, T: 397-418, C: 419-458 | MHC class II | 13 (26-458) | 115 | 40 |
| CD8A (CD8-alpha) | P01732.1 | 22-135 IgV | S: 1-21, E: 22-182, T: 183-203, C: 204-235 | MHC class I | 14 (22-235) | 116 | 41 |
| CD8B (CD8-beta) | P10966.1 | 22-132 IgV | S: 1-21, E: 22-170, T: 171-191, C: 192-210 | MHC class I | 15 (22-210) | 117 | 42 |
| LAG3 | P18627.5 | 37-167 IgV, 168-252 IgC2, 265-343 IgC2, 349-419 IgC2 | S: 1-28, E: 29-450, T: 451-471, C: 472-525 | MHC class II | 16 (29-525) | 118 | 43 |

TABLE 2-continued

IgSF members according to the present disclosure.

| IgSF Member (Synonyms) | NCBI Protein Accession Number/ UniProtKB Protein Identifier | IgSF Region & Domain Class | Other Domains | Cognate Cell Surface Binding Partners | IgSF Member Amino Acid Sequence (SEQ ID NO) Precursor (mature residues) | Mature | ECD |
|---|---|---|---|---|---|---|---|
| HAVCR2 (TIM-3) | Q8TDQ0.3 | 22-124 IgV | S: 1-21, E: 22-202, T: 203-223, C: 224-301 | CEACAM-1, phosphatidylserine, Galectin-9, HMGB1 | 17 (22-301) | 119 | 44 |
| CEACAM1 | P13688.2 | 35-142 IgV, 145-232 IgC2, 237-317 IgC2, 323-413 IgCs | S: 1-34, E: 35-428, T: 429-452, C: 453-526 | TIM-3 | 18 (35-526) | 120 | 45 |
| TIGIT | Q495A1.1 | 22-124 IgV | S: 1-21, E: 22-141, T: 142-162, C: 163-244 | CD155, CD112 | 19 (22-244) | 121 | 46 |
| PVR (CD155) | P15151.2 | 24-139 IgV, 145-237 IgC2, 244-328 IgC2 | S: 1-20, E: 21-343, T: 344-367, C: 368-417 | TIGIT, CD226, CD96, poliovirus | 20 (21-417) | 122 | 47 |
| PVRL2 (CD112) | Q92692.1 | 32-156 IgV, 162-256 IgC2, 261-345 IgC2 | S: 1-31, E: 32-360, T: 361-381, C: 382-538 | TIGIT, CD226, CD112R | 21 (32-538) | 123 | 48 |
| CD226 | Q15762.2 | 19-126 IgC2, 135-239 IgC2 | S: 1-18, E: 19-254, T: 255-275, C: 276-336 | CD155, CD112 | 22 (19-336) | 124 | 49 |
| CD2 | P06729.2 | 25-128 IgV, 129-209 IgC2 | S: 1-24, E: 25-209, T: 210-235, C: 236-351 | CD58 | 23 (25-351) | 125 | 50 |
| CD160 | O95971.1 | 27-122 IgV | N/A | HVEM, MHC family of proteins | 24 (27-159) | 126 | 51 |
| CD200 | P41217.4 | 31-141 IgV, 142-232 IgC2 | S: 1-30, E: 31-232, T: 233-259, C: 260-278 | CD200R | 25 (31-278) | 127 | 52 |
| CD200R1 (CD200R) | Q8TD46.2 | 53-139 IgV, 140-228 IgC2 | S: 1-28, E: 29-243, T: 244-264, C: 265-325 | CD200 | 26 (29-325) | 128 | 53 |
| NCR3 (NKp30) | O14931.1 | 19-126 IgC-like | S: 1-18, E: 19-135, T: 136-156, C: 157-201 | B7-H6 | 27 (19-201) | 129 | 54 |
| VSIG8 | Q5VU13 | 22-141 IgV1, 146-257 IgV2 | S: 1-21, E: 22-263, T: 264-284, C: 285-414 | VISTA | 132 (22-414) | 133 | 134 |

The number of such non-affinity modified or affinity modified IgSF domains present in a "stacked" immunomodulatory protein construct (whether non-wild type combinations or non-wild type arrangements) is at least 2, 3, 4, or 5 and in some embodiments exactly 2, 3, 4, or 5 IgSF domains (whereby determination of the number of affinity modified IgSF domains disregards any non-specific binding fractional sequences thereof and/or substantially immunologically inactive fractional sequences thereof).

In some embodiments of a stacked immunomodulatory protein provided herein, the number of IgSF domains is at least 2 wherein the number of affinity modified and the number of non-affinity modified IgSF domains is each independently at least: 0, 1, 2, 3, 4, 5, or 6. Thus, the number of affinity modified IgSF domains and the number of non-affinity modified IgSF domains, respectively, (affinity modified IgSF domain: non-affinity modified IgSF domain), can be exactly or at least: 2:0 (affinity modified: wild-type), 0:2, 2:1, 1:2, 2:2, 2:3, 3:2, 2:4, 4:2, 1:1, 1:3, 3:1, 1:4, 4:1, 1:5, or 5:1.

In some embodiments of a stacked immunomodulatory protein, at least two of the non-affinity modified and/or affinity modified IgSF domains are identical IgSF domains.

In some embodiments, a stacked immunomodulatory protein provided herein comprises at least two affinity modified and/or non-affinity modified IgSF domains from a single IgSF member but in a non-wild-type arrangement (alternatively, "permutation"). One illustrative example of a non-wild type arrangement or permutation is an immunomodulatory protein comprising a non-wild-type order of affinity modified and/or non-affinity modified IgSF domain sequences relative to those found in the wild-type CD155 whose IgSF domain sequences served as the source of the variant IgSF domains as provided herein. Thus, in one example, the immunomodulatory protein can comprise an IgV proximal and an IgC distal to the transmembrane domain albeit in a non-affinity modified and/or affinity modified form. The presence, in an immunomodulatory protein provided herein, of both non-wild-type combinations and non-wild-type arrangements of non-affinity modified and/or affinity modified IgSF domains, is also within the scope of the provided subject matter.

In some embodiments of a stacked immunomodulatory protein, the non-affinity modified and/or affinity modified IgSF domains are non-identical (i.e., different) IgSF domains. Non-identical affinity modified IgSF domains specifically bind, under specific binding conditions, different cognate binding partners and are "non-identical" irrespective of whether or not the wild-type or unmodified IgSF domains from which they are engineered was the same. Thus, for example, a non-wild-type combination of at least two non-identical IgSF domains in an immunomodulatory protein can comprise at least one IgSF domain sequence whose origin is from and unique to one CD155, and at least one of a second IgSF domain sequence whose origin is from and unique to another IgSF family member that is not CD155, wherein the IgSF domains of the immunomodulatory protein are in non-affinity modified and/or affinity modified form. However, in alternative embodiments, the two non-identical IgSF domains originate from the same IgSF domain sequence but at least one is affinity modified such that they specifically bind to different cognate binding partners.

In some embodiments, the provided immunomodulatory proteins, in addition to containing a variant CD155 polypeptide, also contains at least 1, 2, 3, 4, 5 or 6 additional immunoglobulin superfamily (IgSF) domains, such as an IgD domain of an IgSF family member set forth in Table 2. In some embodiments, the provided immunomodulatory protein contains at least one additional IgSF domain (e.g. second IgSF domain). In some embodiments, the provided immunomodulatory protein contains at least two additional IgSF domains (e.g. second and third IgSF domain). In some embodiments, the provided immunomodulatory protein contains at least three additional IgSF domains (e.g. second, third and fourth). In some embodiments, the provided immunomodulatory protein contains at least four additional IgSF domains (e.g. second, third, fourth and fifth). In some embodiments, the provided immunomodulatory protein contains at least five additional IgSF domains (e.g. second, third, fourth, fifth and sixth). In some embodiments, the provided immunomodulatory protein contains at least six additional IgSF domains (e.g. second, third, fourth, fifth, sixth and seventh). In some embodiments, each of the IgSF domains in the immunomodulatory protein are different. In some embodiments, at least one of the additional IgSF domain is the same as at least one other IgSF domain in the immunomodulatory protein. In some embodiments, each of the IgSF domains is from or derived from a different IgSF family member. In some embodiments, at least two of the IgSF domains is from or derived from the same IgSF family member.

In some embodiments, the additional IgSF domain comprises an IgV domain or an IgC (e.g., IgC2) domain or domains, or a specific binding fragment of the IgV domain or a specific binding fragment of the IgC (e.g., IgC2) domain or domains. In some embodiments, the additional IgSF domain is or comprises a full-length IgV domain. In some embodiments, the additional IgSF domain is or comprises a full-length IgC (e.g., IgC2) domain or domains. In some embodiments, the additional IgSF domain is or comprises a specific binding fragment of the IgV domain. In some embodiments, the additional IgSF domain is or comprises a specific binding fragment of the IgC (e.g., IgC2) domain or domains. In some embodiments, the immunomodulatory protein contains at least two additional IgSF domains from a single (same) IgSF member. For example, in some aspects, the immunomodulatory protein contains an ECD or portion thereof of an IgSF member containing a full-length IgV domain and a full-length IgC (e.g., IgC2) domain or domains or specific binding fragments thereof.

In some embodiments, the provided immunomodulatory proteins contain at least one additional IgSF domain (e.g. a second or, in some cases, also a third IgSF domain) in which at least one additional, e.g., second or third IgSF domain, is an IgSF domain set forth in a wild-type or unmodified IgSF domain or a specific binding fragment thereof contained in the sequence of amino acids set forth in any of SEQ ID NOS: 1-27 and 132. In some embodiments, the wild-type or unmodified IgSF domain is an IgV domain or an IgC domain, such as an IgC1 or IgC2 domain.

In some embodiments, the provided immunomodulatory proteins, in addition to containing a variant CD155 polypeptide, also contains at least one additional affinity-modified IgSF domain (e.g. a second or, in some cases, also a third affinity-modified IgSF domain and so on) in which at least one additional IgSF domain is a vIgD that contains one or more amino acid modifications (e.g. substitution, deletion or mutation) compared to an IgSF domain in a wild-type or unmodified IgSF domain, such as an IgSF domain in an IgSF family member set forth in Table 2. In some embodiments, the additional, e.g., second or third affinity-modified IgSF domain comprises at least 85%, 86%, 87%, 88%, 89%, 90%, 91%, 92%, 93%, 94%, 95%, 96%, 97%, 98%, 99% or more sequence identity to a wild-type or unmodified IgSF domain or a specific binding fragment thereof contained in the sequence of amino acids set forth in any of SEQ ID NOS: 1-27 and 132. In some embodiments, the wild-type or unmodified IgSF domain is an IgV domain or an IgC domain, such as an IgC1 or IgC2 domain. In some embodiments, the additional, e.g., second or third IgSF domain is an affinity-modified IgV domain and/or IgC domain. In some embodiments, the one or more additional IgSF domain is an affinity-modified IgSF domain that contains an IgV domain and/or an IgC (e.g., IgC2) domain or domains, or a specific binding fragment of the IgV domain and/or a specific binding fragment of the IgC (e.g., IgC2) domain or domains, in which the IgV and/or IgC domain contains the amino acid modification(s) (e.g., substitution(s)). In some embodiments, the one or more additional affinity-modified IgSF domain contains an IgV domain containing the amino acid modification(s) (e.g. substitution(s)). In some embodiments, the one or more additional affinity-modified IgSF domain include IgSF domains present in the ECD or a portion of the ECD of the corresponding unmodified IgSF family member, such as a full-length IgV domain and a full-length IgC (e.g., IgC2) domain or domains, or specific binding fragments thereof, in which one or both of the IgV and IgC contain the amino acid modification(s) (e.g. substitution(s)).

In some embodiments, the provided immunomodulatory protein contains at least one additional, (e.g., second or, in some cases, also a third IgSF domain and so on) IgSF domain that is a vIgD that contains one or more amino acid substitutions compared to an IgSF domain (e.g. IgV) of a wild-type or unmodified IgSF domain other than CD155.

In some embodiments, the one or more additional IgSF domain (e.g. second or third IgSF) domain is an IgSF domain (e.g. IgV) of another IgSF family member that itself also binds to an inhibitory receptor In some aspects, the one or more additional IgSF domain (e.g. second or third IgSF) domain is an affinity-modified IgSF domain that is a variant IgSF domain (vIgD) of an IgSF family member that bind to an inhibitory receptor and that contains one or more amino acid substitutions in such an IgSF domain (e.g. IgV), in which, in some cases, the one or more amino acid modifications result in increased binding to the inhibitory receptor. In some embodiments, the vIgD contains one or more amino acid modifications (e.g. substitutions, deletions or additions) in a wild-type or unmodified IgSF domain (e.g. IgV) of an IgSF family member that binds to an inhibitory receptor. In addition to TIGIT, exemplary of such inhibitory receptors are CD112R CTLA-4, LAG3, PD-1, TIM-3, or BTLA. In some embodiments, the one or more additional IgSF domain is from an IgSF family member selected from CD112, PD-L1, PD-L2, CD80 or CEACAM1. Thus, in some aspects, provided are multi-target checkpoint antagonists that target or block activity of more than one inhibitory receptor.

In some embodiments, there is provided an immuno-modulatory protein containing any one of the variant CD155 polypeptides and one or more IgSF domain of an inhibitory receptor, such as a wild-type or unmodified inhibitory receptor. In some embodiments, there is provided an immuno-modulatory protein containing any one of the variant CD155 polypeptides and one or more IgSF domain of CD80, e.g. wild-type or unmodified CD80, such as an IgV domain set forth in SEQ ID NO: 969 or 1043 or an ECD or a portion thereof (containing the IgV and IgC domain or specific binding fragments thereof) set forth in SEQ ID NO:28 or a portion thereof. In some embodiments, there is provided an immunomodulatory protein containing any one of the variant CD155 polypeptides and one or more IgSF domain of PD-L1, e.g. wild-type or unmodified PD-L1, such as an IgV domain set forth in SEQ ID NO:469 or 665 or an ECD or a portion thereof (containing the IgV and IgC domain or specific binding fragments thereof) set forth in SEQ ID NO:30 or 1756 or a portion thereof. In some embodiments, there is provided an immunomodulatory protein containing any one of the variant CD155 polypeptides and one or more IgSF domain of PD-L2, e.g. wild-type or unmodified PD-L2, such as an IgV domain set forth in SEQ ID NO: 666 or 726 or an ECD or a portion thereof (containing the IgV and IgC domain or specific binding fragments thereof) set forth in SEQ ID NO:31 or a portion thereof. In some embodiments, there is provided an immunomodulatory protein containing any one of the variant CD155 polypeptides and one or more IgSF domain of CD112, e.g. wild-type or unmodified CD112, such as an IgV domain set forth in SEQ ID NO:1272 or 1367 or an ECD or a portion thereof (containing the IgV and IgC domain or specific binding fragments thereof) set forth in SEQ ID NO:48 or a portion thereof.

In some embodiments, there is provided an immuno-modulatory protein containing one or more additional IgSF domain (e.g., second or third IgSF) that is a vIgD of an IgSF family member that binds to an inhibitory receptor in which the one or more amino acid modifications in an IgSF domain (e.g. IgV) results in increased binding affinity of the vIgD, or a fusion or immunomodulatory protein containing the vIgD, for its inhibitory receptor cognate binding partner compared to the unmodified IgSF domain, such as binding affinity that is increased more than 1.2-fold, 1.5-fold, 2-fold, 3-fold, 4-fold, 5-fold, 6-fold, 7-fold, 8-fold, 9-fold, 10-fold, 20-fold, 30-fold 40-fold or 50-fold. In some embodiments, the one or more amino acid modifications in an IgSF domain (e.g. IgV) results in increased selectivity of the vIgD, or a fusion or immunomodulatory protein containing the vIgD for its inhibitory receptor compared to the unmodified IgSF domain. In some embodiments, the increased selectivity is a greater ratio of binding of the vIgD for the inhibitory receptor versus another cognate binding partner, such as a cognate binding partner that is not an inhibitory receptor, compared to the ratio of binding of the unmodified IgSF for the inhibitory receptor versus the another cognate binding partner. In some embodiments, the ratio is greater by at least or at least about 1.2-fold, 1.5-fold, 2-fold, 3-fold, 4-fold, 5-fold, 6-fold, 7-fold, 8-fold, 9-fold, 10-fold, 20-fold, 30-fold 40-fold or 50-fold.

In some embodiments, the at least one additional (e.g., second or third) vIgD is an IgSF domain (e.g. IgV) of a variant CD80 polypeptide that contains one or more amino acid modifications (e.g., substitutions, deletions or additions) in the IgSF domain (e.g., IgV) compared to unmodified or wild-type CD80, which, in some aspects, result in increased binding to the inhibitory receptor CTLA-4. Exemplary amino acid modifications, such as substitutions, deletions or additions, in an IgSF domain (e.g. IgV or ECD containing IgV and IgC) of a variant CD80 polypeptide are set forth in Table 3. In some embodiments, there is provided an immunomodulatory protein containing any of the provided variant CD155 polypeptides and a variant CD80 polypeptide containing an IgV domain including any of the amino acid modifications set forth in Table 3, such as the IgV domain set forth in any of SEQ ID NOS: 969-1002, 1004-1042, 1044-1076, 1078-1116 or an IgV domain that has at least 85%, 86%, 87%, 88%, 89%, 90%, 91%, 92%, 93%, 94%, 95%, 96%, 97%, 98%, 99% to any of SEQ ID NOS: 969-1002, 1004-1042, 1044-1076, 1078-1116 and contains the one or more amino acid modifications. In some embodiments, there is provided an immunomodulatory protein containing any of the provided variant CD155 polypeptides and a variant CD80 polypeptide containing an ECD or a portion thereof containing the IgV and/or IgC domains, in which is contained any of the amino acid modifications set forth in Table 3, such as the ECD set forth in any of SEQ ID NOS: 897-928, 930-968 or an ECD that contains at least 85%, 86%, 87%, 88%, 89%, 90%, 91%, 92%, 93%, 94%, 95%, 96%, 97%, 98%, 99% to any of SEQ ID NOS: 897-928, 930-968 and contains the one or more amino acid modifications.

In some embodiments, the at least one additional (e.g. second or third) vIgD is an IgSF domain (e.g. IgV) of a variant PD-L1 polypeptide that contains one or more amino acid modifications (e.g. substitutions, deletions or additions) in an IgSF domain (e.g. IgV) of PD-L1 or PD-L2, which are IgSF family members that bind to the inhibitory receptor PD-1. In some embodiments, the at least one additional (e.g. second or third) vIgD contains one or more amino acid modifications (e.g. substitutions, deletions or additions) in an IgSF domain (e.g. IgV) of CD112, which is IgSF family members that bind to the inhibitory receptor CD112R. In some embodiments, the at least one additional (e.g. second or third) vIgD contains one or more amino acid modifications (e.g. substitutions, deletions or additions) in the IgSF domain (e.g. IgVor ECD) compared to unmodified or wild-type of PD-L1, which, in some aspects, result in increased binding to the inhibitory receptor PD-1. Exemplary amino acid modifications, such as substitutions, deletions or additions, in an IgSF domain (e.g. IgV or ECD containing IgV and IgC) of a variant PD-L1 polypeptide are set forth in Table 4. In some embodiments, there is provided an immunomodulatory protein containing any of the provided variant CD155 polypeptides and a variant PD-L1 polypeptide containing an IgV domain including any of the amino acid modifications set forth in Table 4, such as the IgV domain set forth in any of SEQ ID NOS: 535-664, 1754, 1755, 1936-1965, or an IgV domain that has at least 85%, 86%, 87%, 88%, 89%, 90%, 91%, 92%, 93%, 94%, 95%, 96%, 97%, 98%, 99% to any of SEQ ID NOS: 535-664, 1754, 1755, 1936-1965 and contains the one more amino acid modifications. In some embodiments, there is provided an immunomodulatory protein containing any of the provided variant CD155 polypeptides and a variant PD-L1 polypeptide containing an ECD or a portion thereof containing the IgV and/or IgC domains, in which is contained any of the amino acid modifications set forth in Table 4, such as the ECD set forth in any of SEQ ID NOS: 470-534, 1753, 1757-1935, 1966-2031, or an ECD that contains at least 85%, 86%, 87%, 88%, 89%, 90%, 91%, 92%, 93%, 94%, 95%, 96%, 97%, 98%, 99% to any of SEQ ID NOS: 470-534, 1753, 1757-1935, 1966-2031 and contains the one or more amino acid modifications.

In some embodiments, the at least one additional (e.g., second or third) vIgD is an IgSF domain (e.g. IgV) of a variant PD-L2 polypeptide that contains one or more amino acid modifications (e.g., substitutions, deletions or additions) in the IgSF domain (e.g., IgV) compared to unmodified or wild-type PD-L2, which, in some aspects, result in increased binding to the inhibitory receptor PD-1. Exemplary amino acid modifications, such as substitutions, deletions or additions, in an IgSF domain (e.g. IgV or ECD containing IgV and IgC) of a variant PD-L2 polypeptide are set forth in Table 5. In some embodiments, there is provided an immunomodulatory protein containing any of the provided variant CD155 polypeptides and a variant PD-L2 polypeptide containing an IgV domain including any of the amino acid modifications set forth in Table 5, such as the IgV domain set forth in any of SEQ ID NOS:744-794, 796-870, 872-895 or an IgV domain that has at least 85%, 86%, 87%, 88%, 89%, 90%, 91%, 92%, 93%, 94%, 95%, 96%, 97%, 98%, 99% to any of SEQ ID NOS: 744-794, 796-870, 872-895 and contains the one more more amino acid modifications. In some embodiments, there is provided an immunomodulatory protein containing any of the provided variant CD155 polypeptides and a variant PD-L2 polypeptide containing an ECD or a portion thereof containing the IgV and/or IgC domains, in which is contained any of the amino acid modifications set forth in Table 5, such as the ECD set forth in any of SEQ ID NOS: 667-717, 719-743 or an ECD that contains at least 85%, 86%, 87%, 88%, 89%, 90%, 91%, 92%, 93%, 94%, 95%, 96%, 97%, 98%, 99% to any of SEQ ID NOS: 667-717, 719-743 and contains the one or more amino acid modifications.

In some embodiments, the at least one additional (e.g., second or third) vIgD is an IgSF domain (e.g. IgV) of a variant CD112 polypeptide that contains one or more amino acid modifications (e.g., substitutions, deletions or additions) in the IgSF domain (e.g., IgV) compared to unmodified or wild-type CD112, which, in some aspects, result in increased binding to the inhibitory receptor TIGIT. Exemplary amino acid modifications, such as substitutions, deletions or additions, in an IgSF domain (e.g. IgV or ECD containing IgV and IgC) of a variant CD112 polypeptide are set forth in Table 8. In some embodiments, there is provided an immunomodulatory protein containing any of the provided variant CD155 polypeptides and a variant CD112 polypeptide containing an IgV domain including any of the amino acid modifications set forth in Table 8, such as the IgV domain set forth in any of SEQ ID NOS: 1320-1366, 1368-1414, 1497-1537, 1586-1609, or an IgV domain that has at least 85%, 86%, 87%, 88%, 89%, 90%, 91%, 92%, 93%, 94%, 95%, 96%, 97%, 98%, 99% to any of SEQ ID NOS: 1320-1366, 1368-1414, 1497-1537, 1586-1609 and contains the one more more amino acid modifications. In some embodiments, there is provided an immunomodulatory protein containing any of the provided variant CD155 polypeptides and a variant CD112 polypeptide containing an ECD or a portion thereof containing the IgV and/or IgC domains, in which is contained any of the amino acid modifications set forth in Table 8, such as the ECD set forth in any of SEQ ID NOS: 1273-1319, 1415-1455, 1538-1561, or an ECD that contains at least 85%, 86%, 87%, 88%, 89%, 90%, 91%, 92%, 93%, 94%, 95%, 96%, 97%, 98%, 99% to any of SEQ ID NOS: 1273-1319, 1415-1455, 1538-1561 and contains the one or more amino acid modifications.

In some embodiments, the one or more additional IgSF domain (e.g. second or third IgSF) domain is an IgSF domain (e.g. IgV) of another IgSF family member that binds or recognizes a tumor antigen. In such embodiments, the IgSF family member serves as a tumor-localizing moiety, thereby bringing the vIgD of CD155 in close proximity to immune cells in the tumor microenvironment. In some embodiments, the additional IgSF domain (e.g. second or third IgSF) domain is an IgSF domain of NKp30, which binds or recognizes B7-H6 expressed on a tumor cell. In some embodiments, the at least one additional (e.g. second or third) IgSF domain, e.g. NKp30, is an affinity-modified IgSF domain or vIgD that contains one or more amino acid modifications (e.g. substitutions, deletions or additions). In some embodiments, the one or more amino acid modifications increase binding affinity and/or selectivity to B7-H6 compared to unmodified IgSF domain, e.g. NKp30, such as by at least or at least about 1.2-fold, 1.5-fold, 2-fold, 3-fold, 4-fold, 5-fold, 6-fold, 7-fold, 8-fold, 9-fold, 10-fold, 20-fold, 30-fold 40-fold or 50-fold. Exemplary amino acid modifications, such as substitutions, deletions or additions, in an IgSF domain (e.g. IgC-like or full ECD) of a variant NKp30 polypeptide are set forth in Table 6. Among the exemplary polypeptides is an NKp30 variant that contains the mutations L30V/A60V/S64P/S86G with reference to positions in the NKp30 extracellular domain corresponding to positions set forth in SEQ ID NO: 54. In some embodiments, there is provided an immunomodulatory protein containing any of the provided variant CD155 polypeptides and a variant NKp30 polypeptide containing an IgC-like domain including any of the amino acid modifications set forth in Table 6, such as the IgC-like domain set forth in any of SEQ ID NOS: 1162-1166 or an IgC-like domain that has at least 85%, 86%, 87%, 88%, 89%, 90%, 91%, 92%, 93%, 94%, 95%, 96%, 97%, 98%, 99% to any of SEQ ID NOS: 1162-1166 and contains the one more amino acid modifications. In some embodiments, there is provided an immunomodulatory protein containing any of the provided variant CD155 polypeptides and a variant NKp30 polypeptide containing an ECD or a portion thereof containing an IgSF domain or domains, in which is contained any of the amino acid modifications set forth in Table 6, such as the ECD set forth in any of SEQ ID NOS: 1156-1160 or an ECD that contains at least 85%, 86%, 87%, 88%, 89%, 90%, 91%, 92%, 93%, 94%, 95%, 96%, 97%, 98%, 99% to any of SEQ ID NOS: 1156-1160 and contains the one or more amino acid modifications.

In some embodiments, the at least one additional (e.g., second or third) vIgD is an IgSF domain (e.g. IgV) of a variant CD86 polypeptide that contains one or more amino acid modifications (e.g., substitutions, deletions or additions) in the IgSF domain (e.g., IgV) compared to unmodified or wild-type CD86, which, in some aspects, result in increased binding to its cognate binding partner. Exemplary amino acid modifications, such as substitutions, deletions or additions, in an IgSF domain (e.g. IgV or ECD containing IgV and IgC) of a variant CD86 polypeptide are set forth in Table 7. Among exemplary polypeptides include CD86 variants that contain the mutations Q35H/H90L/Q102H with reference to positions in the CD86 extracellular domain corresponding to positions set forth in SEQ ID NO: 29. In some embodiments, there is provided an immunomodulatory protein containing any of the provided variant CD155 polypeptides and a variant CD86 polypeptide containing an IgV domain including any of the amino acid modifications set forth in Table 7, such as the IgV domain set forth in any of SEQ ID NOS: 1174-1177 or an IgV domain that has at least 85%, 86%, 87%, 88%, 89%, 90%, 91%, 92%, 93%, 94%, 95%, 96%, 97%, 98%, 99% to any of SEQ ID NOS: 1174-1177 and contains the one more more amino acid modifications. In some embodiments, there is provided an immunomodulatory protein containing any of the provided variant CD155 polypeptides and a variant CD86 polypeptide containing an ECD or a portion thereof containing the IgV and/or IgC domains, in which is contained any of the amino acid modifications set forth in Table 7, such as the ECD set forth in any of SEQ ID NOS: 1169-1172 or an ECD that contains at least 85%, 86%, 87%, 88%, 89%, 90%, 91%, 92%, 93%, 94%, 95%, 96%, 97%, 98%, 99% to any of SEQ ID NOS: 1169-1172 and contains the one or more amino acid modifications.

Tables 3-8 provide exemplary polypeptides containing one or more affinity-modified IgSF domains that can be used in stack constructs provided herein.

TABLE 3

Exemplary variant CD80 polypeptides

| Mutation(s) | ECD SEQ ID NO | IgV SEQ ID NO |
| --- | --- | --- |
| Wild-type | 28 | 969, 1043 |
| L70P | 896 | 970, 1044 |
| I30F/L70P | 897 | 971, 1045 |
| Q27H/T41S/A71D | 898 | 972, 1046 |
| I30T/L70R | 899 | 973, 1047 |
| T13R/C16R/L70Q/A71D | 900 | 974, 1048 |
| T57I | 901 | 975, 1049 |
| M43I/C82R | 902 | 976, 1050 |
| V22L/M38V/M47T/A71D/L85M | 903 | 977, 1051 |
| I30V/T57I/L70P/A71D/A91T | 904 | 978, 1052 |
| V22I/L70M/A71D | 905 | 979, 1053 |
| N55D/L70P/E77G | 906 | 980, 1054 |
| T57A/I69T | 907 | 981, 1055 |
| N55D/K86M | 908 | 982, 1056 |
| L72P/T79I | 909 | 983, 1057 |
| L70P/F92S | 910 | 984, 1058 |
| T79P | 911 | 985, 1059 |
| E35D/M47I/L65P/D90N | 912 | 986, 1060 |
| L25S/E35D/M47I/D90N | 913 | 987, 1061 |
| A71D | 915 | 989, 1063 |
| E81K/A91S | 917 | 991, 1065 |
| A12V/M47V/L70M | 918 | 992, 1066 |
| K34E/T41A/L72V | 919 | 993, 1067 |
| T41S/A71D/V84A | 920 | 994, 1068 |
| E35D/A71D | 921 | 995, 1069 |
| E35D/M47I | 922 | 996, 1070 |
| K36R/G78A | 923 | 997, 1071 |
| Q33E/T41A | 924 | 998, 1072 |
| M47V/N48H | 925 | 999, 1073 |
| M47L/V68A | 926 | 1000, 1074 |

TABLE 3-continued

Exemplary variant CD80 polypeptides

| Mutation(s) | ECD SEQ ID NO | IgV SEQ ID NO |
| --- | --- | --- |
| S44P/A71D | 927 | 1001, 1075 |
| Q27H/M43I/A71D/R73S | 928 | 1002, 1076 |
| E35D/T57I/L70Q/A71D | 930 | 1004, 1078 |
| M47I/E88D | 931 | 1005, 1079 |
| M42I/I61V/A71D | 932 | 1006, 1080 |
| P51A/A71D | 933 | 1007, 1081 |
| H18Y/M47I/T57I/A71G | 934 | 1008, 1082 |
| V20I/M47V/T57I/V84I | 935 | 1009, 1083 |
| V20I/M47V/A71D | 936 | 1010, 1084 |
| A71D/L72V/E95K | 937 | 1011, 1085 |
| V22L/E35G/A71D/L72P | 938 | 1012, 1086 |
| E35D/A71D | 939 | 1013, 1087 |
| E35D/I67L/A71D | 940 | 1014, 1088 |
| Q27H/E35G/A71D/L72P/T79I | 941 | 1015, 1089 |
| T13R/M42V/M47I/A71D | 942 | 1016, 1090 |
| E35D | 943 | 1017, 1091 |
| E35D/M47I/L70M | 944 | 1018, 1092 |
| E35D/A71D/L72V | 945 | 1019, 1093 |
| E35D/M43L/L70M | 946 | 1020, 1094 |
| A26P/E35D/M43I/L85Q/E88D | 947 | 1021, 1095 |
| E35D/D46V/L85Q | 948 | 1022, 1096 |
| Q27L/E35D/M47I/T57I/L70Q/E88D | 949 | 1023, 1097 |
| M47V/I69F/A71D/V83I | 950 | 1024, 1098 |
| E35D/T57A/A71D/L85Q | 951 | 1025, 1099 |
| H18Y/A26T/E35D/A71D/L85Q | 952 | 1026, 1100 |
| E35D/M47L | 953 | 1027, 1101 |
| E23D/M42V/M43I/I58V/L70R | 954 | 1028, 1102 |
| V68M/L70M/A71D/E95K | 955 | 1029, 1103 |
| N55I/T57I/I69F | 956 | 1030, 1104 |
| E35D/M43I/A71D | 957 | 1031, 1105 |
| T41S/T57I/L70R | 958 | 1032, 1106 |
| H18Y/A71D/L72P/E88V | 959 | 1033, 1107 |
| V20I/A71D | 960 | 1034, 1108 |
| E23G/A26S/E35D/T62N/A71D/L72V/L85M | 961 | 1035, 1109 |
| A12T/E24D/E35D/D46V/I61V/L72P/E95V | 962 | 1036, 1110 |
| V22L/E35D/M43L/A71G/D76H | 963 | 1037, 1111 |
| E35G/K54E/A71D/L72P | 964 | 1038, 1112 |
| L70Q/A71D | 965 | 1039, 1113 |
| A26E/E35D/M47L/L85Q | 966 | 1040, 1114 |
| D46E/A71D | 967 | 1041, 1115 |
| Y31H/E35D/T41S/V68L/K93R/R94W | 968 | 1042, 1116 |

TABLE 4

Exemplary variant PD-L1 polypeptides

| Mutation(s) | ECD SEQ ID NO | IgV SEQ ID NO |
| --- | --- | --- |
| Wild-type | 30, 1756 | 469, 665 |
| K28N/M41V/N45T/H51N/K57E | 470, 1966 | 535, 600 |
| I20L/I36T/N45D/I47T | 471, 1967 | 536, 601 |
| I20L/M41K/K44E | 472, 1968 | 537, 602 |
| P6S/N45T/N78I/I83T | 473, 1969 | 538, 603 |
| N78I | 474, 1970 | 539, 604 |
| M41K/N78I | 475, 1971 | 540, 605 |
| N45T/N78I | 476, 1972 | 541, 606 |
| I20L/N45T | 477, 1973 | 542, 607 |
| N45T | 478, 1974 | 543, 608 |
| M41K | 479, 1975 | 544, 609 |
| I20L/I36T/N45D | 480, 1976 | 545, 610 |
| N17D/N45T/V50A/D72G | 481, 1977 | 546, 611 |
| I20L/F49S | 482, 1978 | 547, 612 |
| N45T/V50A | 483, 1979 | 548, 613 |
| I20L/N45T/N78I | 484, 1980 | 549, 614 |
| I20L/N45T/V50A | 485, 1981 | 550, 615 |
| M41V/N45T | 486, 1982 | 551, 616 |
| M41K/N45T | 487, 1983 | 552, 617 |
| A33D/S75P/D85E | 488, 1984 | 553, 618 |
| M18I/M41K/D43G/H51R/N78I | 489, 1985 | 554, 619 |
| V11E/I20L/I36T/N45D/H60R/S75P | 490, 1986 | 555, 620 |

TABLE 4-continued

Exemplary variant PD-L1 polypeptides

| Mutation(s) | ECD SEQ ID NO | IgV SEQ ID NO |
|---|---|---|
| A33D/V50A | 491, 1987 | 556, 621 |
| S16G/A33D/K71E/S75P | 492, 1988 | 557, 622 |
| E27G/N45T/M97I | 493, 1989 | 558, 623 |
| E27G/N45T/K57R | 494, 1990 | 559, 624 |
| A33D/E53V | 495, 1991 | 560, 625 |
| D43G/N45D/V58A | 496, 1992 | 561, 626 |
| E40G/D43V/N45T/V50A | 497, 1993 | 562, 627 |
| Y14S/K28E/N45T | 498, 1994 | 563, 628 |
| A33D/N78S | 499, 1995 | 564, 629 |
| A33D/N78I | 500, 1996 | 565, 630 |
| A33D/N45T | 501, 1997 | 566, 631 |
| A33D/N45T/N78I | 502, 1998 | 567, 632 |
| E27G/N45T/V50A | 503, 1999 | 568, 633 |
| N45T/V50A/N78S | 504, 2000 | 569, 634 |
| I20L/N45T/V110M | 505, 2001 | 570,635 |
| I20L/I36T/N45T/V50A | 506, 2002 | 571, 636 |
| N45T/L74P/S75P | 507, 2003 | 572, 637 |
| N45T/S75P | 508, 2004 | 573, 638 |
| S75P/K106R | 509, 2005 | 574, 639 |
| S75P | 510, 2006 | 575, 640 |
| A33D/S75P | 511, 2007 | 576, 641 |
| A33D/S75P/D104G | 512, 2008 | 577, 642 |
| A33D/S75P | 513, 2009 | 578, 643 |
| I20L/E27G/N45T/V50A | 514, 2010 | 579, 644 |
| I20L/E27G/D43G/N45D/V58A/N78I | 515, 2011 | 580, 645 |
| I20L/D43G/N45D/V58A/N78I | 516, 2012 | 581, 646 |
| I20L/A33D/D43G/N45D/V58A/N78I | 517, 2013 | 582, 647 |
| I20L/D43G/N45D/N78I | 518, 2014 | 583, 648 |
| E27G/N45T/V50A/N78I | 519, 2015 | 584, 649 |
| N45T/V50A/N78I | 520, 2016 | 585, 650 |
| V11A/I20L/E27G/D43G/N45D/H51Y/S99G | 521, 2017 | 586, 651 |
| I20L/E27G/D43G/N45T/V50A | 522, 2018 | 587, 652 |
| I20L/K28E/D43G/N45D/V58A/Q89R | 523, 2019 | 588, 653 |
| I20L/I36T/N45D | 524, 2020 | 589, 654 |
| I20L/K28E/D43G/N45D/E53G/V58A/N78I | 525, 2021 | 590, 655 |
| A33D/D43G/N45D/V58A/S75P | 526, 2022 | 591, 656 |
| K23R/D43G/N45D | 527, 2023 | 592, 657 |
| I20L/D43G/N45D/V58A/N78I/D90G/G101D | 528, 2024 | 593, 658 |
| D43G/N45D/L56Q/V58A/G101G-ins(G101GG) | 529, 2025 | 594, 659 |
| I20L/K23E/D43G/N45D/V58A/N78I | 530, 2026 | 595, 660 |
| I20L/K23E/D43G/N45D/V50A/N78I | 531, 2027 | 596, 661 |
| T19I/E27G/N45I/V50A/N78I/M97K | 532, 2028 | 597, 662 |
| I20L/M41K/D43G/N45D | 533, 2029 | 598, 663 |
| K23R/N45T/N78I | 534, 2030 | 599, 664 |
| I20L/K28E/D43G/N45D/V58A/Q89R/G101G-ins (G101GG) | 1753, 2031 | 1754, 1755 |
| K57R/S99G | 1757, 1847 | 1936, 1951 |
| K57R/S99G/F189L | 1758, 1848 | |
| M18V/M97L/F193S/R195G/E200K/H202Q | 1759, 1849 | |
| I36S/M41K/M97L/K144Q/R195G/E200K/H202Q/L206 | 1760, 1850 | |
| C22R/Q65L/L124S/K144Q/R195G/E200N/H202Q/T221 | 1761 | |
| M18V/I98L/L124S/P198T/L206F | 1762, 1851 | |
| S99G/N117S/I148V/K171R/R180S | 1763, 1852 | |
| I36T/M97L/A103V/Q155H | 1764, 1853 | |
| K28I/S99G | 1765, 1854 | 1937, 1952 |
| R195S | 1766, 1855 | |
| A79T/S99G/T185A/R195G/E200K/H202Q/L206F | 1767, 1856 | |
| K57R/S99G/L124S/K144Q | 1768, 1857 | |
| K57R/S99G/R195G | 1769, 1858 | |
| D55V/M97L/S99G | 1770, 1859 | 1938, 1953 |
| E27G/I36T/D55N/M97L/K111E | 1771, 1860 | 1939, 1954 |
| E54G/M97L/S99G | 1772, 1861 | 1940, 1955 |
| G15A/I36T/M97L/K111E/H202Q | 1773, 1862 | |
| G15A/I36T/V129D | 1774, 1863 | |
| G15A/I36T/V129D/R195G | 1775, 1864 | |
| G15A/V129D | 1776, 1865 | |
| I36S/M97L | 1777, 1866 | 1941, 1956 |
| I36T/D55N/M97L/K111E/A204T | 1778, 1867 | |
| I36T/D55N/M97L/K111E/V129A/F173L | 1779, 1868 | |
| I36T/D55S/M97L/K111E/I148V/R180S | 1780, 1869 | |

TABLE 4-continued

Exemplary variant PD-L1 polypeptides

| Mutation(s) | ECD SEQ ID NO | IgV SEQ ID NO |
|---|---|---|
| I36T/G52R/M97L/V112A/K144E/V175A/P198T | 1781, 1870 | |
| I36T/I46V/D55G/M97L/K106E/K144E/T185A/R195G | 1782, 1871 | |
| I36T/I83T/M97L/K144E/P198T | 1783, 1872 | |
| I36T/M97L/K111E | 1784, 1873 | 1942, 1957 |
| I36T/M97L/K144E/P198T | 1785, 1874 | |
| I36T/M97L/Q155H/F193S/N201Y | 1786, 1875 | |
| I36T/M97L/V129D | 1787, 1876 | |
| L35P/I36S/M97L/K111E | 1788, 1877 | 1943, 1958 |
| M18I/I36T/E53G/M97L/K144E/E199G/V207A | 1789, 1878 | |
| M18T/I36T/D55N/M97L/K111E | 1790, 1879 | 1944, 1959 |
| M18V/M97L/T176N/R195G | 1791, 1880 | |
| M97L/S99G | 1792, 1881 | 1945, 1960 |
| N17D/M97L/S99G | 1793, 1882 | 1946, 1961 |
| S99G/T185A/R195G/P198T | 1794, 1883 | |
| V129D/H202Q | 1795, 1884 | |
| V129D/P198T | 1796, 1885 | |
| V129D/T150A | 1797, 1886 | |
| V93E/V129D | 1798, 1887 | |
| Y10F/M18V/S99G/Q138R/T203A | 1799, 1888 | |
| N45D | 1800, 1889 | 1947, 1962 |
| K160M/R195G | 1801, 1890 | |
| N45D/K144E | 1802, 1891 | |
| N45D/P198S | 1803, 1892 | |
| N45D/P198T | 1804, 1893 | |
| N45D/R195G | 1805, 1894 | |
| N45D/R195S | 1806, 1895 | |
| N45D/S131F | 1807, 1896 | |
| N45D/V58D | 1808, 1897 | 1948, 1963 |
| V129D/R195S | 1809, 1898 | |
| I98T/F173Y/L196S | 1810, 1899 | |
| N45D/E134G/L213P | 1811, 1900 | |
| N45D/F173I/S177C | 1812, 1901 | |
| N45D/I148V/R195G | 1813, 1902 | |
| N45D/K111T/R195G | 1814, 1903 | |
| N45D/N113Y/R195S | 1815, 1904 | |
| N45D/N165Y/E170G | 1816, 1905 | |
| N45D/Q89R/I98V | 1817, 1906 | 1949, 1964 |
| N45D/S131F/P198S | 1818, 1907 | |
| N45D/S75P/P198S | 1819, 1908 | |
| N45D/V50A/R195T | 1820, 1909 | |
| E27D/N45D/T183A/I188V | 1821, 1910 | |
| F173Y/T183I/L196S/T203A | 1822, 1911 | |
| K23N/N45D/S75P/N120S | 1823, 1912 | |
| N45D/G102D/R194W/R195G | 1824, 1913 | |
| N45D/G52V/Q121L/P198S | 1825, 1914 | |
| N45D/I148V/R195G/N201D | 1826, 1915 | |
| N45D/K111T/T183A/I188V | 1827, 1916 | |
| N45D/Q89R/F189S/P198S | 1828, 1917 | |
| N45D/S99G/C137R/V207A | 1829, 1918 | |
| N45D/T163I/K167R/R195G | 1830, 1919 | |
| N45D/T183A/T192S/R194G | 1831, 1920 | |
| N45D/V50A/I119T/K144E | 1832, 1921 | |
| T19A/N45D/K144E/R195G | 1833, 1922 | |
| V11E/N45D/T130A/P198T | 1834, 1923 | |
| V26A/N45D/T163I/T185A | 1835, 1924 | |
| K23N/N45D/L124S/K167T/R195G | 1836, 1925 | |
| K23N/N45D/Q73R/T163I | 1837, 1926 | |
| K28E/N45D/W149R/S158G/P198T | 1838, 1927 | |
| K28R/N45D/K57E/I98V/R195S | 1839, 1928 | |
| K28R/N45D/V129D/T163N/R195T | 1840, 1929 | |
| M41K/D43G/N45D/R64S/R195G | 1841, 1930 | |
| M41K/D43G/N45D/R64S/S99G | 1842, 1931 | 1950, 1965 |
| N45D/R68L/F173L/D197G/P198S | 1843, 1932 | |
| N45D/V50A/I148V/R195G/N201D | 1844, 1933 | |
| M41K/D43G/K44E/N45D/R195G/N201D | 1845, 1934 | |
| N45D/V50A/L124S/K144E/L179P/R195G | 1846, 1935 | |

TABLE 5

Exemplary variant PD-L2 polypeptides

| Mutation(s) | ECD SEQ ID NO | IgV SEQ ID NO |
|---|---|---|
| Wild-type | 31 | 666, 726 |
| H15Q | 667 | 744, 820 |
| N24D | 668 | 745, 821 |
| E44D | 669 | 746, 822 |
| V89D | 670 | 747, 823 |
| Q82R/V89D | 671 | 748, 824 |
| E59G/Q82R | 672 | 749, 825 |
| S39I/V89D | 673 | 750, 826 |
| S67L/V89D | 674 | 751, 827 |
| S67L/I85F | 675 | 752, 828 |
| S67L/I86T | 676 | 753, 829 |
| H15Q/K65R | 677 | 754, 830 |
| H15Q/Q72H/V89D | 678 | 755, 831 |
| H15Q/S67L/R76G | 679 | 756, 832 |
| H15Q/R76G/I85F | 680 | 757, 833 |
| H15Q/T47A/Q82R | 681 | 758, 834 |
| H15Q/Q82R/V89D | 682 | 759, 835 |
| H15Q/C23S/I86T | 683 | 760, 836 |
| H15Q/S39I/I86T | 684 | 761, 837 |
| H15Q/R76G/I85F | 685 | 762, 838 |
| E44D/V89D/W91R | 686 | 763, 839 |
| I13V/S67L/V89D | 687 | 764, 840 |
| H15Q/S67L/I86T | 688 | 765, 841 |
| I13V/H15Q/S67L/I86T | 689 | 766, 842 |
| I13V/H15Q/E44D/V89D | 690 | 767, 843 |
| I13V/S39I/E44D/Q82R/V89D | 691 | 768, 844 |
| I13V/E44D/Q82R/V89D | 692 | 769, 845 |
| I13V/Q72H/R76G/I86T | 693 | 770, 846 |
| I13V/H15Q/R76G/I85F | 694 | 771, 847 |
| H15Q/S39I/R76G/V89D | 695 | 772, 848 |
| H15Q/S67L/R76G/I85F | 696 | 773, 849 |
| H15Q/T47A/Q72H/R76G/I86T | 697 | 774, 850 |
| H15Q/T47A/Q72H/R76G | 698 | 775, 851 |
| I13V/H15Q/T47A/Q72H/R76G | 699 | 776, 852 |
| H15Q/E44D/R76G/I85F | 700 | 777, 853 |
| H15Q/S39I/S67L/V89D | 701 | 778, 854 |
| H15Q/N32D/S67L/V89D | 702 | 779, 855 |
| N32D/S67L/V89D | 703 | 780, 856 |
| H15Q/S67L/Q72H/R76G/V89D | 704 | 781, 857 |
| H15Q/Q72H/Q74R/R76G/I86T | 705 | 782, 858 |
| G28V/Q72H/R76G/I86T | 706 | 783, 859 |
| I13V/H15Q/S39I/E44D/S67L | 707 | 784, 860 |
| E44D/S67L/Q72H/Q82R/V89D | 708 | 785, 861 |
| H15Q/V89D | 709 | 786, 862 |
| H15Q/T47A | 710 | 787, 863 |
| I13V/H15Q/Q82R | 711 | 788, 864 |
| I13V/H15Q/V89D | 712 | 789, 865 |
| I13V/S67L/Q82R/V89D | 713 | 790, 866 |
| I13V/H15Q/Q82R/V89D | 714 | 791, 867 |
| H15Q/V31M/S67L/Q82R/V89D | 715 | 792, 868 |
| I13V/H15Q/T47A/Q82R | 716 | 793, 869 |
| I13V/H15Q/V31A/N45S/Q82R/V89D | 717 | 794, 870 |
| H15Q/T47A/H69L/Q82R/V89D | 719 | 796, 872 |
| I13V/H15Q/T47A/H69L/R76G/V89D | 720 | 797, 873 |
| I12V/I13V/H15Q/T47A/Q82R/V89D | 721 | 798, 874 |
| I13V/H15Q/R76G/D77N/Q82R/V89D | 722 | 799, 875 |
| I13V/H15Q/T47A/R76G/V89D | 723 | 800, 876 |
| I13V/H15Q/T47A/Q82R/V89D | 724 | 801, 877 |
| I13V/H15Q/N24D/Q82R/V89D | 725 | 802, 878 |
| I13V/H15Q/I36V/T47A/S67L/V89D | 727 | 803, 879 |
| H15Q/T47A/K65R/S67L/Q82R/V89D | 728 | 804, 880 |
| H15Q/L33P/T47A/S67L/P71S/V89D | 729 | 805, 881 |
| I13V/H15Q/Q72H/R76G/I86T | 730 | 806, 882 |
| H15Q/T47A/S67L/Q82R/V89D | 731 | 807, 883 |
| F2L/H15Q/D46E/T47A/Q72H/R76G/Q82R/V89D | 732 | 808, 884 |
| I13V/H15Q/L33F/T47A/Q82R/V89D | 733 | 809, 885 |
| I13V/H15Q/T47A/E58G/S67L/Q82R/V89D | 734 | 810, 886 |
| H15Q/N24S/T47A/Q72H/R76G/V89D | 735 | 811, 887 |
| I13V/H15Q/E44V/T47A/Q82R/V89D | 736 | 812, 888 |
| H15Q/N18D/T47A/Q72H/V73A/R76G/I86T/V89D | 737 | 813, 889 |
| I13V/H15Q/T37A/E44D/S48C/S67L/Q82R/V89D | 738 | 814, 890 |
| H15Q/L33H/S67L/R76G/Q82R/V89D | 739 | 815, 891 |
| I13V/H15Q/T47A/Q72H/R76G/I86T | 740 | 816, 892 |
| H15Q/S39I/E44D/Q72H/V75G/R76G/Q82R/V89D | 741 | 817, 893 |

TABLE 5-continued

Exemplary variant PD-L2 polypeptides

| Mutation(s) | ECD SEQ ID NO | IgV SEQ ID NO |
|---|---|---|
| H15Q/T47A/S67L/R76G/Q82R/V89D | 742 | 818, 894 |
| I13V/H15Q/T47A/S67L/Q72H/R76G/Q82R/V89D | 743 | 819, 895 |

TABLE 6

Exemplary variant NKp30 polypeptides

| Mutation(s) | ECD SEQ ID NO | IgC-like domain SEQ ID NO |
|---|---|---|
| Wild-type | 54 | 1161 |
| L30V/A60V/S64P/S86G | 1156 | 1162 |
| L30V | 1157 | 1163 |
| A60V | 1158 | 1164 |
| S64P | 1159 | 1165 |
| S86G | 1160 | 1166 |

TABLE 7

Exemplary variant CD86 polypeptides

| Mutation(s) | ECD SEQ ID NO | IgV SEQ ID NO |
|---|---|---|
| Wild-type | 29 | 1173 |
| Q35H/H90L/Q102H | 1169 | 1174 |
| Q35H | 1170 | 1175 |
| H90L | 1171 | 1176 |
| Q102H | 1172 | 1177 |

TABLE 8

Exemplary variant CD112 polypeptides

| Mutation(s) | ECD SEQ ID NO | IgV SEQ ID NO |
|---|---|---|
| Wild-type | 48 | 1272, 1367 |
| Y33H/A112V/G117D | 1273 | 1320, 1368 |
| V19A/Y33H/S64G/S80G/G98S/N106Y/A112V | 1274 | 1321, 1369 |
| L32P/A112V | 1275 | 1322, 1370 |
| A95V/A112I | 1276 | 1323, 1371 |
| P28S/A112V | 1277 | 1324, 1372 |
| P27A/T38N/V101A/A112V | 1278 | 1325, 1373 |
| S118F | 1279 | 1326, 1374 |
| R12W/H48Y/F54S/S118F | 1280 | 1327, 1375 |
| R12W/Q79R/S118F | 1281 | 1328, 1376 |
| T113S/S118Y | 1282 | 1329, 1377 |
| S118Y | 1283 | 1330, 1378 |
| N106I/S118Y | 1284 | 1331, 1379 |
| N106I/S118F | 1285 | 1332, 1380 |
| A95T/L96P/S118Y | 1286 | 1333, 1381 |
| Y33H/P67S/N106Y/A112V | 1287 | 1334, 1382 |
| N106Y/A112V | 1288 | 1335, 1383 |
| T18S/Y33H/A112V | 1289 | 1336, 1384 |
| P9S/Y33H/N47S/A112V | 1290 | 1337, 1385 |
| P42S/P67H/A112V | 1291 | 1338, 1386 |
| P27L/L32P/P42S/A112V | 1292 | 1339, 1387 |
| G98D/A112V | 1293 | 1340, 1388 |
| Y33H/S35P/N106Y/A112V | 1294 | 1341, 1389 |
| L32P/P42S/T100A/A112V | 1295 | 1342, 1390 |
| P27S/P45S/N106I/A112V | 1296 | 1343, 1391 |
| Y33H/N47K/A112V | 1297 | 1344, 1392 |

TABLE 8-continued

| Exemplary variant CD112 polypeptides | | |
| --- | --- | --- |
| Mutation(s) | ECD SEQ ID NO | IgV SEQ ID NO |
| Y33H/N106Y/A112V | 1298 | 1345, 1393 |
| K78R/D84G/A112V/F114S | 1299 | 1346, 1394 |
| Y33H/N47K/F54L/A112V | 1300 | 1347, 1395 |
| Y33H/A112V | 1301 | 1348, 1396 |
| A95V/A112V | 1302 | 1349, 1397 |
| R12W/A112V | 1303 | 1350, 1398 |
| R12W/P27S/A112V | 1304 | 1351, 1399 |
| Y33H/V51M/A112V | 1305 | 1352, 1400 |
| Y33H/A112V/S118T | 1306 | 1353, 1401 |
| Y33H/V101A/A112V/P115S | 1307 | 1354, 1402 |
| H24R/T38N/D43G/A112V | 1308 | 1355, 1403 |
| A112V | 1309 | 1356, 1404 |
| P27A/A112V | 1310 | 1357, 1405 |
| A112V/S118T | 1311 | 1358, 1406 |
| R12W/A112V/M1221 | 1312 | 1359, 1407 |
| Q83K/N106Y/A112V | 1313 | 1360, 1408 |
| R12W/P27S/A112V/S118T | 1314 | 1361, 1409 |
| P28S/Y33H/A112V | 1315 | 1362, 1410 |
| P27S/Q90R/A112V | 1316 | 1363, 1411 |
| L15V/P27A/A112V/S118T | 1317 | 1364, 1412 |
| Y33H/N106Y/T108I/A112V | 1318 | 1365, 1413 |
| Y33H/P56L/V75M/V101M/A112V | 1319 | 1366, 1414 |
| N47K/Q79R/S118F | 1415 | 1456, 1497 |
| Q40R/P60T/A112V/S118T | 1416 | 1457, 1498 |
| F114Y/S118F | 1417 | 1458, 1499 |
| Y33H/K78R/S118Y | 1418 | 1459, 1500 |
| R12W/A46T/K66M/Q79R/N106I/T113A/S118F | 1419 | 1460, 1501 |
| Y33H/A112V/S118F | 1420 | 1461, 1502 |
| R12W/Y33H/N106I/S118F | 1421 | 1462, 1503 |
| L15V/Q90R/S118F | 1422 | 1463, 1504 |
| N47K/D84G/N106I/S118Y | 1423 | 1464, 1505 |
| L32P/S118F | 1424 | 1465, 1506 |
| Y33H/Q79R/A112V/S118Y | 1425 | 1466, 1507 |
| T18A/N106I/S118T | 1426 | 1467, 1508 |
| L15V/Y33H/N106Y/A112V/S118F | 1427 | 1468, 1509 |
| V37M/S118F | 1428 | 1469, 1510 |
| N47K/A112V/S118Y | 1429 | 1470, 1511 |
| A461/A112V | 1430 | 1471, 1512 |
| P28S/Y33H/N106I/S118Y | 1431 | 1472, 1513 |
| P30S/Y33H/N47K/V75M/Q79R/N106I/S118Y | 1432 | 1473, 1514 |
| V19A/N47K/N106Y/K116E/S118Y | 1433 | 1474, 1515 |
| Q79R/T85A/A112V/S118Y | 1434 | 1475, 1516 |
| V101M/N106I/S118Y | 1435 | 1476, 1517 |
| Y33H/Q79R/N106I/A112V/S118T | 1436 | 1477, 1518 |
| Q79R/A112V | 1437 | 1478, 1519 |
| Y33H/A46I/Q79R/N106I/S118F | 1438 | 1479, 1520 |
| A112V/G121S | 1439 | 1480, 1521 |
| Y33H/Q79R/N106I/S118Y | 1440 | 1481, 1522 |
| Y33H/N106I/A112V | 1441 | 1482, 1523 |
| Y33H/A46T/V101M/A112V/S118T | 1442 | 1483, 1524 |
| L32P/L99M/N106I/S118F | 1443 | 1484, 1525 |
| L32P/T108A/S118F | 1444 | 1485, 1526 |
| R12W/Q79R/A112V | 1445 | 1486, 1527 |
| Y33H/N106Y/E110G/A112V | 1446 | 1487, 1528 |
| Y33H/N106I/S118Y | 1447 | 1488, 1529 |
| Q79R/S118F | 1448 | 1489, 1530 |
| Y33H/Q79R/G98D/V101M/A112V | 1449 | 1490, 1531 |
| N47K/T81S/V101M/A112V/S118F | 1450 | 1491, 1532 |
| G82S/S118Y | 1451 | 1492, 1533 |
| Y33H/A112V/S118Y | 1452 | 1493, 1534 |
| Y33H/N47K/Q79R/N106Y/A112V | 1453 | 1494, 1535 |
| Y33H/S118T | 1454 | 1495, 1536 |
| R12W/Y33H/Q79R/V101M/A112V | 1455 | 1496, 1537 |
| Y33H/Q83K/A112V/S118T | 1538 | 1562, 1586 |
| V29M/Y33H/N106I/S118F | 1539 | 1563, 1587 |
| Y33H/A46T/A112V | 1540 | 1564, 1588 |
| Y33H/Q79R/S118F | 1541 | 1565, 1589 |
| Y33H/N47K/F74L/S118F | 1542 | 1566, 1590 |
| R12W/V101M/N106I/S118Y | 1543 | 1567, 1591 |
| A46T/V101A/N106I/S118Y | 1544 | 1568, 1592 |
| N106Y/A112V/S118T | 1545 | 1569, 1593 |
| S76P/T811/V101M/N106Y/A112V/S118F | 1546 | 1570, 1594 |
| P9R/L21V/P22L/I34M/S69F/F74L/ A87V/A112V/L125A | 1547 | 1571, 1595 |

TABLE 8-continued

| Exemplary variant CD112 polypeptides | | |
| --- | --- | --- |
| Mutation(s) | ECD SEQ ID NO | IgV SEQ ID NO |
| Y33H/V101M/A112V | 1548 | 1572, 1596 |
| V29A/L32P/S118F | 1549 | 1573, 1597 |
| Y33H/V101M/N106I/A112V | 1550 | 1574, 1598 |
| R12W/Y33H/N47K/Q79R/S118Y | 1551 | 1575, 1599 |
| Y33H/A46T/A112V/S118T | 1552 | 1576, 1600 |
| Y33H/A112V/F114L/S118T | 1553 | 1577, 1601 |
| Y33H/T38A/A46T/V101M/A112V | 1554 | 1578, 1602 |
| P28S/Y33H/S69P/N106I/A112V/S118Y | 1555 | 1579, 1603 |
| Y33H/P42L/N47K/V101M/A112V | 1556 | 1580, 1604 |
| Y33H/N47K/F74S/Q83K/N106I/F111L/ A112V/S118T | 1557 | 1581, 1605 |
| Y33H/A112V/S118T/V119A | 1558 | 1582, 1606 |
| Y33H/N106I/A112V/S118F | 1559 | 1583, 1607 |
| Y33H/K66M/S118F/W124L | 1560 | 1584, 1608 |
| N106I/A112V | 1561 | 1585, 1609 |

In some embodiments, the two or more IgSF domain, including a vIgD of CD155 and one or more additional IgSF domain (e.g. second or third variant IgSF domain) from another IgSF family member, are covalently or non-covalently linked. A plurality of non-affinity modified and/or affinity modified IgSF domains in a stacked immunomodulatory protein polypeptide chain need not be covalently linked directly to one another. In some embodiments, the two or more IgSF domains are linked directly or indirectly, such as via a linker. In some embodiments, an intervening span of one or more amino acid residues indirectly covalently bonds IgSF domains to each other. The linkage can be via the N-terminal to C-terminal residues. In some embodiments, the linkage can be made via side chains of amino acid residues that are not located at the N-terminus or C-terminus of the IgSF domain(s). Thus, linkages can be made via terminal or internal amino acid residues or combinations thereof.

Figure 5A:
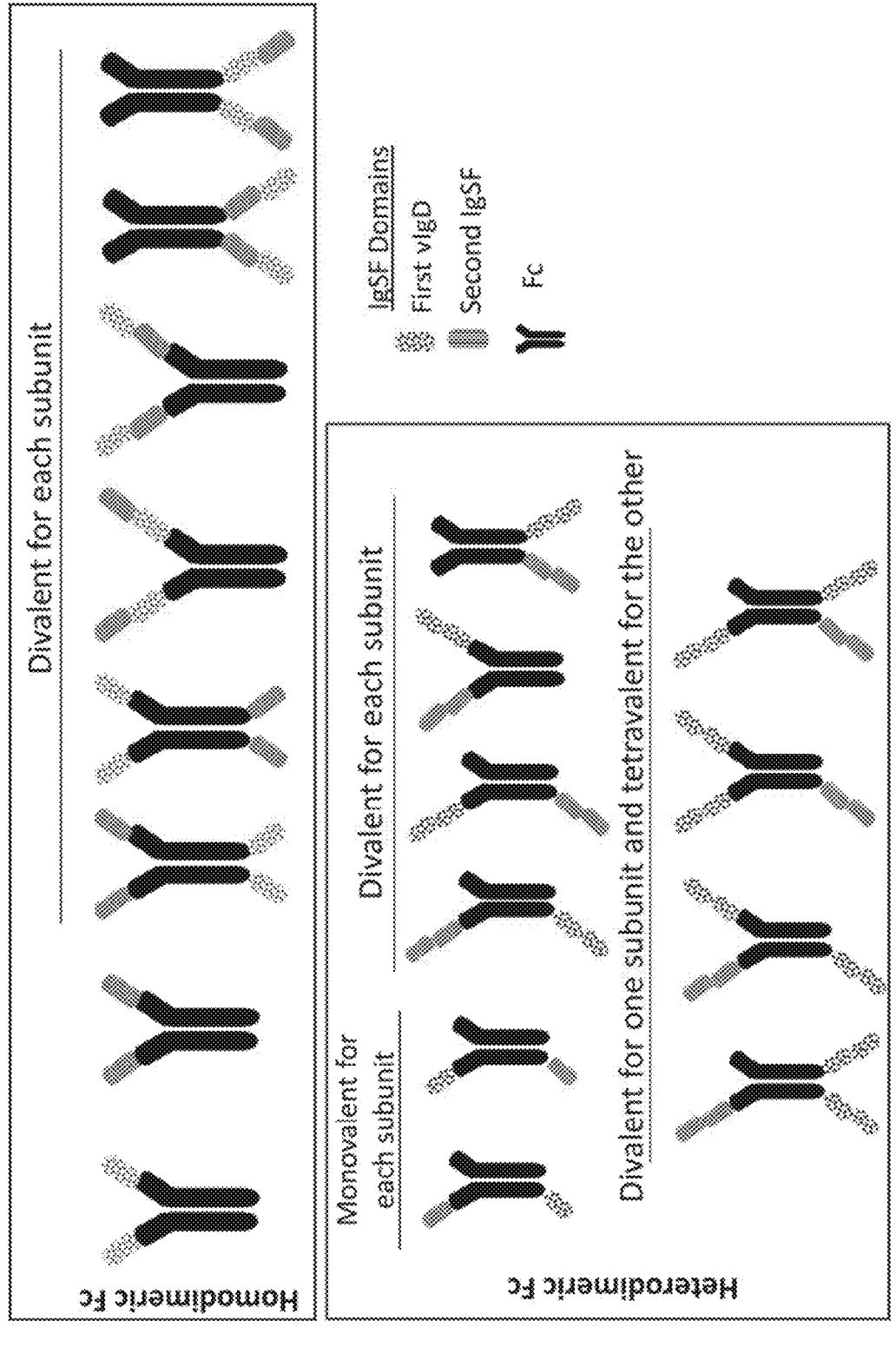
FIG. 5A depicts various exemplary configurations of a stack molecule containing a first variant IgSF domain (first vIgD) and a second IgSF domain, such as a second variant IgSF domain (second vIgD). As shown, the first vIgD and second IgSF domain are independently linked, directly or indirectly, to the N- or C-terminus of an Fc region. For generating a homodimeric Fc molecule, the Fc region is one that is capable of forming a homodimer with a matched Fc subunit by co-expression of the individual Fc regions in a cell. For generating a heterodimeric Fc molecule, the indi-vidual Fc regions contain mutations (e.g. "knob-into-hole" mutations in the CH3 domain), such that formation of the heterodimer is favored compared to homodimers when the individual Fc regions are co-expressed in a cell.
Figure 5B:
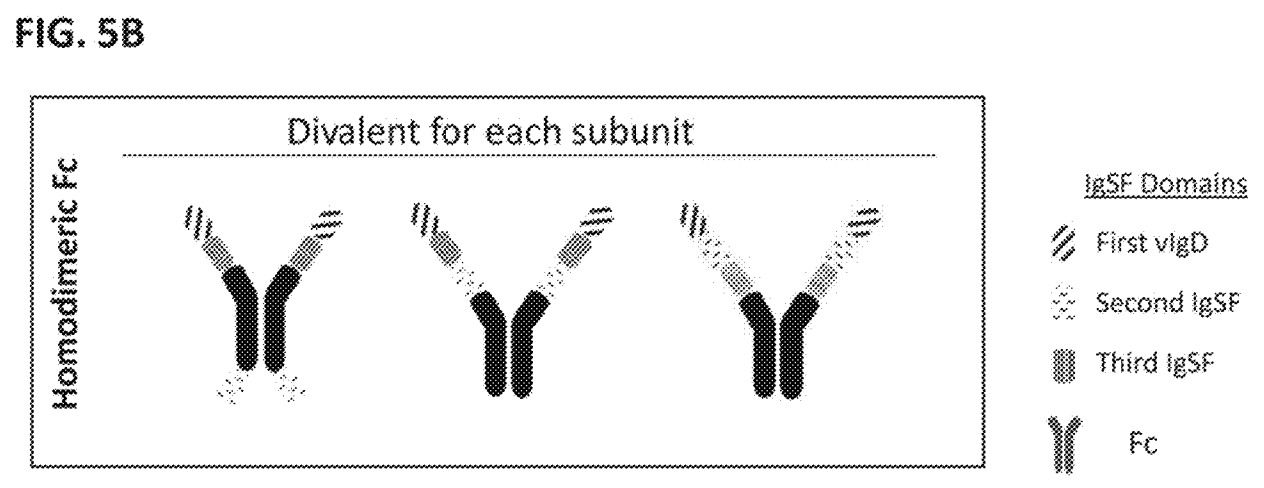

In some embodiments, the immunomodulatory protein contains at least two IgSF domains, each linked directly or indirectly via a linker. In some embodiments, the immunomodulatory protein contains at least three immunomodulatory proteins, each linked directly or indirectly via a linker. Various configurations are shown in FIGS. 5A and 5B.

In some embodiments, one or more "peptide linkers" link the vIgD of CD155 and one or more additional IgSF domain (e.g. second or third variant IgSF domain). In some embodiments, a peptide linker can be a single amino acid residue or greater in length. In some embodiments, the peptide linker has at least one amino acid residue but is no more than 20, 19, 18, 17, 16, 15, 14, 13, 12, 11, 10, 9, 8, 7, 6, 5, 4, 3, 2, or 1 amino acid residues in length. In some embodiments, the linker is (in one-letter amino acid code): GGGGS ("4GS"; SEQ ID NO: 1752) or multimers of the 4GS linker, such as repeats of 2, 3, 4, or 5 4GS linkers. In some embodiments, the peptide linker is $(GGGGS)_2$ SEQ ID NO: 1182 or $(GGGGS)_3$ SEQ ID NO: 1181. In some embodiments, the linker also can include a series of alanine residues alone or in addition to another peptide linker (such as a 4GS linker or multimer thereof). In some embodiments, the number of alanine residues in each series is: 2, 3, 4, 5, or 6 alanines.

In some embodiments, the non-affinity modified and/or affinity modified IgSF domains are linked by "wild-type peptide linkers" inserted at the N-terminus and/or C-terminus of a second non-affinity modified and/or affinity modified IgSF domains. These linkers are also called leading sequences (N-terminal to non-affinity modified or affinity modified IgSF domain) or trailing sequences (C-terminal to non-affinity modified or affinity modified IgSF domain), and sequences that exist in the wild-type protein that span immediately outside the structural prediction of the Ig fold of the IgSF. In some embodiments, the "wild-type linker" is an amino acid sequence that exists after the signal sequence, but before in the IgSF domain, such as the defined IgV domain, in the amino acid sequence of the wild-type protein. In some embodiments, the "wild-type" linker is an amino acid sequence that exists immediately after the IgSF domain, such as immediately after the defined IgV domain but before the IgC domain, in the amino acid sequence of the wild-type protein. These linker sequences can contribute to the proper folding and function of the neighboring IgSF domain(s). In some embodiments, there is present a leading peptide linker inserted at the N-terminus of the first IgSF domain and/or a trailing sequence inserted at the C-terminus of the first non-affinity modified and/or affinity modified IgSF domain. In some embodiments, there is present a second leading peptide linker inserted at the N-terminus of the second IgSF domain and/or a second trailing sequence inserted at the C-terminus of the second non-affinity modified and/or affinity modified IgSF domain. When the first and second non-affinity modified and/or affinity modified IgSF domains are derived from the same parental protein and are connected in the same orientation, wild-type peptide linkers between the first and second non-affinity modified and/or affinity modified IgSF domains are not duplicated. For example, when the first trailing wild-type peptide linker and the second leading wild-type peptide linker are the same, the Type II immunomodulatory protein does not comprise either the first trailing wild-type peptide linker or the second leading wild-type peptide linker.

In some embodiments, the Type II immunomodulatory protein comprises a first leading wild-type peptide linker inserted at the N-terminus of the first non-affinity modified and/or affinity modified IgSF domain, wherein the first leading wild-type peptide linker comprises at least 5 (such as at least about any of 6, 7, 8, 9, 10, 11, 12, 13, 14, 15, or more) consecutive amino acids from the intervening sequence in the wild-type protein from which the first non-affinity modified and/or affinity modified IgSF domain is derived between the parental IgSF domain and the immediately preceding domain (such as a signal peptide or an IgSF domain). In some embodiments, the first leading wild-type peptide linker comprises the entire intervening sequence in the wild-type protein from which the first non-affinity modified and/or affinity modified IgSF domain is derived between the parental IgSF domain and the immediately preceding domain (such as a signal peptide or an IgSF domain).

In some embodiments, the Type II immunomodulatory protein further comprises a first trailing wild-type peptide linker inserted at the C-terminus of the first non-affinity modified and/or affinity modified IgSF domain, wherein the first trailing wild-type peptide linker comprises at least 5 (such as at least about any of 6, 7, 8, 9, 10, 11, 12, 13, 14, 15, or more) consecutive amino acids from the intervening sequence in the wild-type protein from which the first non-affinity modified and/or affinity modified IgSF domain is derived between the parental IgSF domain and the immediately following domain (such as an IgSF domain or a transmembrane domain). In some embodiments, the first trailing wild-type peptide linker comprises the entire intervening sequence in the wild-type protein from which the first non-affinity modified and/or affinity modified IgSF domain is derived between the parental IgSF domain and the immediately following domain (such as an IgSF domain or a transmembrane domain).

In some embodiments, the Type II immunomodulatory protein further comprises a second leading wild-type peptide linker inserted at the N-terminus of the second non-affinity modified and/or affinity modified IgSF domain, wherein the second leading wild-type peptide linker comprises at least 5 (such as at least about any of 6, 7, 8, 9, 10, 11, 12, 13, 14, 15, or more) consecutive amino acids from the intervening sequence in the wild-type protein from which the second non-affinity modified and/or affinity modified IgSF domain is derived between the parental IgSF domain and the immediately preceding domain (such as a signal peptide or an IgSF domain). In some embodiments, the second leading wild-type peptide linker comprises the entire intervening sequence in the wild-type protein from which the second non-affinity modified and/or affinity modified IgSF domain is derived between the parental IgSF domain and the immediately preceding domain (such as a signal peptide or an IgSF domain).

In some embodiments, the Type II immunomodulatory protein further comprises a second trailing wild-type peptide linker inserted at the C-terminus of the second non-affinity modified and/or affinity modified IgSF domain, wherein the second trailing wild-type peptide linker comprises at least 5 (such as at least about any of 6, 7, 8, 9, 10, 11, 12, 13, 14, 15, or more) consecutive amino acids from the intervening sequence in the wild-type protein from which the second non-affinity modified and/or affinity modified IgSF domain is derived between the parental IgSF domain and the immediately following domain (such as an IgSF domain or a transmembrane domain). In some embodiments, the second trailing wild-type peptide linker comprises the entire intervening sequence in the wild-type protein from which the second non-affinity modified and/or affinity modified IgSF domain is derived between the parental IgSF domain and the immediately following domain (such as an IgSF domain or a transmembrane domain).

In some embodiments, the two or more IgSF domain, including a vIgD of CD155 and one or more additional IgSF domain (e.g. second and/or third variant IgSF domain) from another IgSF family member, are linked or attached to an Fc to form an Fc fusion, which, upon expression in a cell can, in some aspects, produce a dimeric multi-domain stack immunomodulatory protein. Thus, also provided are dimeric multi-domain immunomodulatory proteins.

In some embodiments, the variant CD155 polypeptide and one or more additional IgSF domain are independently linked, directly or indirectly, to the N- or C-terminus of an Fc region. In some embodiments, the variant CD155 polypeptide and at least one of the one or more additional IgSF domain are linked, directly or indirectly, and one of the variant CD155 and one of the one or more additional IgSF domain is also linked, directly or indirectly, to the N- or C-terminus of an Fc region. In some embodiments, the N- or C-terminus of the Fc region is linked to the variant CD155 polypeptide or the one or more additional IgSF domain and the other of the N- or C-terminus of the Fc region is linked to the other of the CD155 variant or another of the one or more additional IgSF domain. In some embodiments, linkage to the Fc is via a peptide linker, e.g. a peptide linker, such as described above. In some embodiments, linkage between the variant CD155 and second IgSF domain is via a peptide linker, e.g. a peptide linker, such as described above. In some embodiments, linkage between the variant CD155 and the one or more additional IgSF domain is via a peptide linker, e.g., a peptide linker, such as described above. In some embodiments, the vIgD of CD155, the one or more additional IgSF domains, and the Fc domain can be linked together in any of numerous configurations as depicted in FIGS. 5A and 5B. Exemplary configurations are described in the Examples.

In some embodiments, the stacked immunomodulatory protein is a dimer formed by two immunomodulatory Fc fusion polypeptides. Also provided are nucleic acid molecules encoding any of the stacked immunomodulatory proteins. In some embodiments, the dimeric multi-domain stack immunomodulatory protein can be produced in cells by expression, or in some cases co-expression, of stack immunomodulatory Fc region polypeptides, such as described above in accord with generating dimeric Fc fusion proteins.

In some embodiments, the dimeric multi-domain stack immunomodulatory protein is divalent for each Fc subunit, monovalent for each subunit, or divalent for one subunit and tetravalent for the other.

In some embodiments, the dimeric multi-domain stack immunomodulatory protein is a homodimeric multi-domain stack Fc protein. In some embodiments, the dimeric multi-domain stack immunomodulatory protein comprises a first stack immunomodulatory Fc fusion polypeptide and a second stack immunomodulatory Fc fusion polypeptide in which the first and second polypeptide are the same. In some embodiments, the multi-domain stack molecule contains a first Fc fusion polypeptide containing a variant CD155 and a second IgSF domain and a second Fc fusion polypeptide containing the variant CD155 and the second IgSF domain. In some embodiments, the multi-domain stack molecule contains a first Fc fusion polypeptide containing a variant CD155, a second IgSF domain, and a third IgSF domain and a second Fc fusion polypeptide containing the variant CD155, the second IgSF domain, and the third IgSF domain. In some embodiments, the Fc portion of the first and/or second fusion polypeptide can be any Fc as described above. In some embodiments, the Fc portion or region of the first and second fusion polypeptide is the same.

In some embodiments, the multi-domain stack molecule is heterodimeric, comprising two different Fc fusion polypeptides, e.g. a first and a second Fc polypeptide, wherein at least one is an Fc fusion polypeptide containing at least one variant CD155 polypeptide and/or at least one is an Fc polypeptide containing a second IgSF domain (e.g. second variant IgSF domain). In some embodiments, the first or second Fc fusion polypeptide further contains a third IgSF domain (e.g. third variant IgSF domain). In some embodiments, the multi-domain stack molecule contains a first Fc fusion polypeptide containing a variant CD155 and a second Fc fusion polypeptide containing at a second IgSF domain, in which, in some cases, the first or second Fc fusion polypeptide additionally contains a third IgSF domain. In some embodiments, the multi-domain stack molecule contains a first Fc fusion polypeptide containing a variant CD155, a second IgSF domain, and in some cases, a third IgSF domain and a second Fc fusion polypeptide that is not linked to either a variant CD155 polypeptide or an additional IgSF domain. In some embodiments, the Fc portion or region of the first and second fusion polypeptide is the same. In some embodiments, the Fc portion or region of the first and second fusion polypeptide is different. In some embodiments, the multi-domain stack molecule contains a first fusion Fc polypeptides containing 1, 2, 3, 4 or more variant CD155 polypeptides and 1, 2, 3, 4 or more additional IgSF domains, wherein the total number of IgSF domains in the first stack Fc fusion polypeptide is greater than 2, 3, 4, 5, 6 or more. In one example of such an embodiment, the second stack Fc fusion polypeptide contains 1, 2, 3, 4 or more variant CD155 polypeptides and 1, 2, 3, 4 or more additional IgSF domains, wherein the total number of IgSF domains in the second stack Fc fusion polypeptide is greater than 2, 3, 4, 5, 6 or more. In another example of such embodiments, the second Fc polypeptide is not linked to either a variant CD155 polypeptide or additional IgSF domain.

In some embodiments, the heterodimeric stack molecule contains a first stack immunomodulatory Fc fusion polypeptide and a second stack immunomodulatory Fc fusion polypeptide in which the first and second polypeptide are different. In some embodiments, a heterodimeric stack molecule contains a first Fc polypeptide fusion containing an Fc region and a first variant CD155 polypeptide and/or second IgSF domain (e.g. second variant IgSF domain) and a second Fc polypeptide fusion containing an Fc region and the other of the first variant CD155 polypeptide or the second IgSF domain. In some embodiments, a heterodimeric stack molecule contains a first Fc polypeptide fusion containing an Fc region and a first variant CD155 polypeptide and/or second IgSF domain (e.g. second variant IgSF domain) and a second Fc polypeptide fusion containing an Fc region and both the first variant CD155 polypeptide and second IgSF domain (e.g. second variant IgSF domain) but in a different orientation or configuration from the first Fc region. In some embodiments, the first and/or second Fc fusion polypeptide also contains a third IgSF domain (e.g. third variant IgSF domain).

In some embodiments, the Fc domain of one or both of the first and second stacked immunomodulatory Fc fusion polypeptide comprises a modification (e.g. substitution) such that the interface of the Fc molecule is modified to facilitate and/or promote heterodimerization. In some embodiments, modifications include introduction of a protuberance (knob) into a first Fc polypeptide and a cavity (hole) into a second Fc polypeptide such that the protuberance is positionable in the cavity to promote complexing of the first and second Fc-containing polypeptides. Amino acids targeted for replacement and/or modification to create protuberances or cavities in a polypeptide are typically interface amino acids that interact or contact with one or more amino acids in the interface of a second polypeptide.

In some embodiments, a sequence of amino acids is added preceding the Fc sequence for constructs in which the Fc sequence is the N-terminal portion of the sequence. In some cases, the sequence of amino acids HMSSVSAQ (SEQ ID NO:1027) is added immediately preceding the Fc sequence for constructs in which the Fc sequence is the N-terminal portion of the sequence. In some embodiments, a heterodimeric stack molecule contains a first Fc polypeptide fusion containing an Fc region (knob) and a first variant CD155 polypeptide and/or second IgSF domain (e.g. second variant IgSF domain) and a second Fc polypeptide fusion containing an Fc region (hole) and a stuffer sequence HMSSVSAQ (SEQ ID NO:1027) added immediately preceding both Fc regions of the first and second Fc polypeptide fusion.

In some embodiments, a first polypeptide that is modified to contain protuberance (hole) amino acids include replacement of a native or original amino acid with an amino acid that has at least one side chain which projects from the interface of the first polypeptide and is therefore positionable in a compensatory cavity (hole) in an adjacent interface of a second polypeptide. Most often, the replacement amino acid is one which has a larger side chain volume than the original amino acid residue. One of skill in the art knows how to determine and/or assess the properties of amino acid residues to identify those that are ideal replacement amino acids to create a protuberance. In some embodiments, the replacement residues for the formation of a protuberance are naturally occurring amino acid residues and include, for example, arginine (R), phenylalanine (F), tyrosine (Y), or tryptophan (W). In some examples, the original residue identified for replacement is an amino acid residue that has a small side chain such as, for example, alanine, asparagine, aspartic acid, glycine, serine, threonine, or valine.

In some embodiments, a second polypeptide that is modified to contain a cavity (hole) is one that includes replacement of a native or original amino acid with an amino acid that has at least one side chain that is recessed from the interface of the second polypeptide and thus is able to accommodate a corresponding protuberance from the interface of a first polypeptide. Most often, the replacement amino acid is one which has a smaller side chain volume than the original amino acid residue. One of skill in the art knows how to determine and/or assess the properties of amino acid residues to identify those that are ideal replacement residues for the formation of a cavity. Generally, the replacement residues for the formation of a cavity are naturally occurring amino acids and include, for example, alanine (A), serine (S), threonine (T) and valine (V). In some examples, the original amino acid identified for replacement is an amino acid that has a large side chain such as, for example, tyrosine, arginine, phenylalanine, or tryptophan.

The CH3 interface of human IgG1, for example, involves sixteen residues on each domain located on four anti-parallel β-strands which buries 1090 A2 from each surface (see e.g., Deisenhofer et al. (1981) Biochemistry, 20:2361-2370; Miller et al., (1990) J Mol. Biol., 216, 965-973; Ridgway et al., (1996) Prot. Engin., 9: 617-621; U.S. Pat. No. 5,731, 168). Modifications of a CH3 domain to create protuberances or cavities are described, for example, in U.S. Pat. No. 5,731,168; International Patent Applications WO98/50431 and WO 2005/063816; and Ridgway et al., (1996) Prot. Engin., 9: 617-621. In some examples, modifications of a CH3 domain to create protuberances or cavities are typically targeted to residues located on the two central anti-parallel β-strands. The aim is to minimize the risk that the protuberances which are created can be accommodated by protruding into the surrounding solvent rather than being accommodated by a compensatory cavity in the partner CH3 domain.

In some embodiments, the heterodimeric molecule contains a T366W mutation in the CH3 domain of the "knobs chain" and T366S, L368A, Y407V mutations in the CH3 domain of the "hole chain". In some cases, an additional interchain disulfide bridge between the CH3 domains can also be used (Merchant, A. M., et al., Nature Biotech. 16 (1998) 677-681) e.g. by introducing a Y349C mutation into the CH3 domain of the "knobs" or "hole" chain and a E356C mutation or a S354C mutation into the CH3 domain of the other chain. In some embodiments, the heterodimeric molecule contains S354C, T366W mutations in one of the two CH3 domains and Y349C, T366S, L368A, Y407V mutations in the other of the two CH3 domains. In some embodiments, the heterodimeric molecule comprises E356C, T366W mutations in one of the two CH3 domains and Y349C, T366S, L368A, Y407V mutations in the other of the two CH3 domains. In some embodiments, the heterodimeric molecule comprises Y349C, T366W mutations in one of the two CH3 domains and E356C, T366S, L368A, Y407V mutations in the other of the two CH3 domains. In some embodiments, the heterodimeric molecule comprises Y349C, T366W mutations in one of the two CH3 domains and S354C, T366S, L368A, Y407V mutations in the other of the two CH3 domains. Examples of other knobs-in-holes technologies are known in the art, e.g. as described by EP 1 870 459 A1.

In some embodiments, the Fc regions of the heterodimeric molecule additionally can contain one or more other Fc mutation, such as any described above. In some embodiments, the heterodimer molecule contains an Fc region with a mutation that reduces effector function.

In some embodiments, an Fc variant containing CH3 protuberance (knob) or cavity(hole) modifications can be joined to a stacked immunomodulatory polypeptide anywhere, but typically via its N- or C-terminus, to the N- or C-terminus of a first and/or second stacked immunomodulatory polypeptide, such as to form a fusion polypeptide. The linkage can be direct or indirect via a linker. Typically, a knob and hole molecule is generated by co-expression of a first stacked immunomodulatory polypeptide linked to an Fc variant containing CH3 protuberance modification(s) with a second stacked immunomodulatory polypeptide linked to an Fc variant containing CH3 cavity modification(s).

There is provided herein a homodimeric multi-domain stack molecule produced from a stack immunomodulatory Fc fusion polypeptide containing an IgSF domain, e.g. IgV domain, of a variant CD155 polypeptide and a second IgSF domain, e.g. IgV, of a variant CD112 polypeptide. In some embodiments, the first and second immunomodulatory Fc fusion polypeptide of the multi-domain stack molecule has the sequence set forth in any of SEQ ID NOS: 1260, 1261, 1262, 1263, 1264, or 1265 or a sequence of amino acids that has at least 85%, 86%, 87%, 88%, 89%, 90%, 91%, 92%, 93%, 94%, 95%, 96%, 97%, 98%, 99% or more sequence identity to any of SEQ ID NOS: 1260, 1261, 1262, 1263, 1264, or 1265 and contains the one more amino acid modifications in the variant CD112 and/or CD155 IgSF domain. In some embodiments, the resulting multi-domain stack molecules bind to both TIGIT and CD112R. In some aspects, the binding to TIGIT is to the same or similar degree or, in some cases, is increased, compared to the binding to TIGIT of the corresponding IgSF domain of unmodified or wild-type CD112 or CD155. In some aspects, the binding to CD112R is to the same or similar degree or, in some cases, is increased, compared to the binding to CD112R of the corresponding IgSF domain of unmodified or wild-type CD112. In some embodiments, the binding to TIGIT or CD112R is at least 30%, 40%, 50%, 60%, 70%, 80%, 90%, or more of the binding to TIGIT or CD112R of the non-stacked form of the variant CD112 IgSF-Fc. In some embodiments, the binding to TIGIT is at least 30%, 40%, 50%, 60%, 70%, 80%, 90% or more of the binding to TIGIT of the non-stacked form of the variant CD155 IgSF-Fc. In some embodiments, the resulting multi-domain stack molecule increases T cell immune responses compared to the non-stack variant CD112 IgSF-Fc and/or variant CD155-IgSF-Fc, such as determined in a reporter assay. In some embodiments, the increase is greater than 1.2-fold, 1.3-fold, 1.4-fold, 1.5-fold, 2.0-fold, 3.0-fold, 4.0-fold, 5.0-fold or more.

There is provided herein a homodimeric multi-domain stack molecule produced from a stack immunomodulatory Fc fusion polypeptide containing an IgSF domain, e.g. IgV domain, of a variant CD155 polypeptide and a second IgSF domain, e.g. IgV, of a variant PD-L1 polypeptide. In some embodiments, the first and second immunomodulatory Fc fusion polypeptide of the multi-domain stack molecule has the sequence set forth in any of SEQ ID NOS: 1254, 1255, 1256, 1257, 1258, or 1259 or a sequence of amino acids that has at least 85%, 86%, 87%, 88%, 89%, 90%, 91%, 92%, 93%, 94%, 95%, 96%, 97%, 98%, 99% or more sequence identity to any of SEQ ID NOS: 1254, 1255, 1256, 1257, 1258, or 1259 and contains the one more amino acid modifications in the variant PD-L1 and/or CD155 IgSF domain. In some embodiments, the resulting multi-domain stack molecules bind to both TIGIT and PD-1. In some aspects, the binding to TIGIT is to the same or similar degree or, in some cases, is increased, compared to the binding to TIGIT of the corresponding IgSF domain of unmodified or wild-type CD155. In some aspects, the binding to PD-1 is to the same or similar degree or, in some cases, is increased, compared to the binding to PD-1 of the corresponding IgSF domain of unmodified or wild-type PD-L1. In some embodiments, the binding to TIGIT or PD-1 is at least 30%, 40%, 50%, 60%, 70%, 80%, 90%, or more of the binding to TIGIT or PD-1 of the non-stacked form of the variant CD155 IgSF-Fc. In some embodiments, the binding to TIGIT is at least 30%, 40%, 50%, 60%, 70%, 80%, 90% or more of the binding to TIGIT of the non-stacked form of the variant CD155 IgSF-Fc. In some embodiments, the resulting multi-domain stack molecule increases T cell immune responses compared to the non-stack variant PD-L1 IgSF-Fc and/or variant CD155-IgSF-Fc, such as determined in a reporter assay. In some embodiments, the increase is greater than 1.2-fold, 1.3-fold, 1.4-fold, 1.5-fold, 2.0-fold, 3.0-fold, 4.0-fold, 5.0-fold or more.

There is provided herein a homodimeric multi-domain stack molecule produced from a stack immunomodulatory Fc fusion polypeptide containing an IgSF domain, e.g. IgV domain, of a variant CD155 polypeptide and a second IgSF domain, e.g. IgV, of a variant PD-L2 polypeptide. In some embodiments, the first and second immunomodulatory Fc fusion polypeptide of the multi-domain stack molecule has the sequence set forth in any of SEQ ID NOS: 1121, 1122, 1123, 1124, 1125, or 1126 or a sequence of amino acids that has at least 85%, 86%, 87%, 88%, 89%, 90%, 91%, 92%, 93%, 94%, 95%, 96%, 97%, 98%, 99% or more sequence identity to any of SEQ ID NOS: 1121, 1122, 1123, 1124, 1125, or 1126 and contains the one more amino acid modifications in the variant PD-L2 and/or CD155 IgSF domain. In some embodiments, the resulting multi-domain stack molecules bind to both TIGIT and PD-1. In some aspects, the binding to TIGIT is to the same or similar degree or, in some cases, is increased, compared to the binding to TIGIT of the corresponding IgSF domain of unmodified or wild-type CD155. In some aspects, the binding to PD-1 is to the same or similar degree or, in some cases, is increased, compared to the binding to PD-1 of the corresponding IgSF domain of unmodified or wild-type PD-L1. In some embodiments, the binding to TIGIT or PD-1 is at least 30%, 40%, 50%, 60%, 70%, 80%, 90%, or more of the binding to TIGIT or PD-1 of the non-stacked form of the variant CD155 IgSF-Fc. In some embodiments, the binding to TIGIT is at least 30%, 40%, 50%, 60%, 70%, 80%, 90% or more of the binding to TIGIT of the non-stacked form of the variant CD155 IgSF-Fc. In some embodiments, the resulting multi-domain stack molecule increases T cell immune responses compared to the non-stack variant PD-L2 IgSF-Fc and/or variant CD155-IgSF-Fc, such as determined in a reporter assay. In some embodiments, the increase is greater than 1.2-fold, 1.3-fold, 1.4-fold, 1.5-fold, 2.0-fold, 3.0-fold, 4.0-fold, 5.0-fold or more.

There is provided herein a heterodimeric multi-domain stack molecule produced from a stack immunomodulatory Fc fusion polypeptide containing an IgSF domain, e.g. IgV domain, of a variant CD155 polypeptide and a second IgSF domain, e.g. IgV, of a variant PD-L2 polypeptide. In some embodiments, the first and second immunomodulatory Fc fusion polypeptide of the multi-domain stack molecule comprises a knob molecule that has the sequence set forth in any of SEQ ID NOS: 1127, 1128, 1129, 1130, 1131, or 1133, or a sequence of amino acids that has at least 85%, 86%, 87%, 88%, 89%, 90%, 91%, 92%, 93%, 94%, 95%, 96%, 97%, 98%, 99% or more sequence identity to any of SEQ ID NOS: 1127, 1128, 1129, 1130, 1131, or 1133, and contains the one more amino acid modifications in the variant PD-L2 and/or CD155 IgSF domain. In some embodiments, the first and second immunomodulatory Fc fusion polypeptide of the multi-domain stack molecule comprises a hole molecule that has the sequence set forth in any of SEQ ID NOS: 1118, 1132, or 1134, or a sequence of amino acids that has at least 85%, 86%, 87%, 88%, 89%, 90%, 91%, 92%, 93%, 94%, 95%, 96%, 97%, 98%, 99% or more sequence identity to any of SEQ ID NOS: 1118, 1132, or 1134, and contains the one more amino acid modifications in the variant PD-L2 and/or CD155 IgSF domain. In some embodiments, the resulting multi-domain stack molecules bind to both TIGIT and PD-1. In some embodiments, the knob and hole molecules are expressed in various combinations and is generated by co-expression of a first stacked immunomodulatory polypeptide linked to an Fc variant containing CH3 protuberance modification(s) with a second stacked immunomodulatory polypeptide linked to an Fc variant containing CH3 cavity modification(s). For example, the first and second immunomodulatory Fc fusion polypeptide of the multi-domain stack molecule comprises a knob and hole molecule that has the pair of sequences set forth in any of SEQ ID NOS: 1127+1118, 1128+1118, 1129+1118, 1130+1118, 1133+1134, 1131+1132, 1129+1132, 1129+1134, 1130+1132, 1130+1134, or a sequence of amino acids that has at least 85%, 86%, 87%, 88%, 89%, 90%, 91%, 92%, 93%, 94%, 95%, 96%, 97%, 98%, 99% or more sequence identity to any of the pairs of SEQ ID NOS: 1127+1118, 1128+1118, 1129+1118, 1130+1118, 1133+1134, 1131+1132, 1129+1132, 1129+1134, 1130+1132, 1130+1134, and contains the one more amino acid modifications in the variant PD-L2 and/or CD155 IgSF domain. In some cases, the knob or hole molecule includes a N-terminal HMSSVSAQ set forth in SEQ ID NO:1120. In some aspects, the binding to TIGIT is to the same or similar degree or, in some cases, is increased, compared to the binding to TIGIT of the corresponding IgSF domain of unmodified or wild-type CD155. In some aspects, the binding to PD-1 is to the same or similar degree or, in some cases, is increased, compared to the binding to PD-1 of the corresponding IgSF domain of unmodified or wild-type PD-L2. In some embodiments, the binding to TIGIT or PD-1 is at least 30%, 40%, 50%, 60%, 70%, 80%, 90%, or more of the binding to TIGIT or PD-1 of the non-stacked form of the variant CD155 IgSF-Fc. In some embodiments, the binding to TIGIT is at least 30%, 40%, 50%, 60%, 70%, 80%, 90% or more of the binding to TIGIT of the non-stacked form of the variant CD155 IgSF-Fc. In some embodiments, the resulting multi-domain stack molecule increases T cell immune responses compared to the non-stack variant PD-L2 IgSF-Fc and/or variant CD155-IgSF-Fc, such as determined in a reporter assay. In some embodiments, the increase is greater than 1.2-fold, 1.3-fold, 1.4-fold, 1.5-fold, 2.0-fold, 3.0-fold, 4.0-fold, 5.0-fold or more.

There is provided herein a homodimeric multi-domain stack molecule produced from a stack immunomodulatory Fc fusion polypeptide containing an IgSF domain, e.g. IgV domain, of a variant CD112 polypeptide, a second IgSF domain, e.g. IgV, of a variant CD155 polypeptide and a third IgSF domain, e.g. IgV, of a variant PD-L1 polypeptide. In some embodiments, the first and second immunomodulatory Fc fusion polypeptide of the multi-domain stack molecule has the sequence set forth in any of SEQ ID NOS: 1266, 1267, and 1268 or a sequence of amino acids that has at least 85%, 86%, 87%, 88%, 89%, 90%, 91%, 92%, 93%, 94%, 95%, 96%, 97%, 98%, 99% or more sequence identity to any of SEQ ID NOS: 1266, 1267, and 1268 and contains the one more amino acid modifications in the variant CD112, CD155 and/or PD-L1 IgSF domain. In some embodiments, the resulting multi-domain stack molecules bind to both TIGIT, CD112R and PD-1. In some aspects, the binding to TIGIT is to the same or similar degree or, in some cases, is increased, compared to the binding to TIGIT of the corresponding IgSF domain of unmodified or wild-type CD112 or CD155. In some aspects, the binding to CD112R is to the same or similar degree, or, in some cases, is increased, compared to the binding to CD112R of the corresponding IgSF domain of unmodified or wild-type CD112. In some aspects, the binding to PD-1 is to the same or similar degree, or, in some cases, is increased, compared to the binding to PD-1 of the corresponding IgSF domain of unmodified or wild-type PD-L1. In some embodiments, the binding to TIGIT or CD112R is at least 30%, 40%, 50%, 60%, 70%, 80%, 90%, or more of the binding to TIGIT or CD112R of the non-stacked form of the variant CD112 IgSF-Fc. In some embodiments, the binding to TIGIT is at least 30%, 40%, 50%, 60%, 70%, 80%, 90% or more of the binding to TIGIT of the non-stacked form of the variant CD155 IgSF-Fc. In some embodiments, the binding to PD-1 is at least 30%, 40%, 50%, 60%, 70%, 80%, 90% or more of the binding to PD-1 of the non-stacked form of the variant PD-1 IgSF-Fc. In some embodiments, the resulting multi-domain stack molecule increases T cell immune responses compared to the non-stack variant CD112 IgSF-Fc, variant CD155-IgSF-Fc and/or variant PD-L1-IgSF-Fc, such as determined in a reporter assay. In some embodiments, the increase is greater than 1.2-fold, 1.3-fold, 1.4-fold, 1.5-fold, 2.0-fold, 3.0-fold, 4.0-fold, 5.0-fold or more.

C. Conjugates and Fusions of Variant Polypeptides and Immunomodulatory Proteins

In some embodiments, the variant polypeptides provided herein, which are immunomodulatory proteins comprising variants of an Ig domain of the IgSF family (vIgD), can be conjugated with or fused with a moiety, such as an effector moiety, such as another protein, directly or indirectly, to form a conjugate ("IgSF conjugate"). In some embodiments, the attachment can be covalent or non-covalent, e.g., via a biotin-streptavidin non-covalent interaction. In some embodiments of a CD155-Fc variant fusion, any one or combination of any two or more of the foregoing conjugates can be attached to the Fc or to the variant CD155 polypeptide or to both.

In some embodiments, the moiety can be a targeting moiety, a small molecule drug (non-polypeptide drug of less than 500 daltons molar mass), a toxin, a cytostatic agent, a cytotoxic agent, an immunosuppressive agent, a radioactive agent suitable for diagnostic purposes, a radioactive metal ion for therapeutic purposes, a prodrug-activating enzyme, an agent that increases biological half-life, or a diagnostic or detectable agent.

In some embodiments the effector moiety is a therapeutic agent, such as a cancer therapeutic agent, which is either cytotoxic, cytostatic or otherwise provides some therapeutic benefit. In some embodiments, the effector moiety is a targeting moiety or agent, such as an agent that targets a cell surface antigen, e.g., an antigen on the surface of a tumor cell. In some embodiments, the effector moiety is a label, which can generate a detectable signal, either directly or indirectly. In some embodiments, the effector moiety is a toxin. In some embodiments, the effector moiety is a protein, peptide, nucleic acid, small molecule or nanoparticle.

In some embodiments, 1, 2, 3, 4, 5 or more effector moieties, which can be the same or different, are conjugated, linked or fused to the variant polypeptide or protein to form an IgSF conjugate. In some embodiments, such effector moieties can be attached to the variant polypeptide or immunomodulatory protein using various molecular biological or chemical conjugation and linkage methods known in the art and described below. In some embodiments, linkers such as peptide linkers, cleavable linkers, non-cleavable linkers or linkers that aid in the conjugation reaction, can be used to link or conjugate the effector moieties to the variant polypeptide or immunomodulatory protein.

In some embodiments, the IgSF conjugate comprises the following components: (protein or polypeptide), $(L)_q$ and (effector moiety)$_m$, wherein the protein or polypeptide is any of the described variant polypeptides or immunomodulatory proteins capable of binding one or more cognate counter structure ligands as described; L is a linker for linking the protein or polypeptide to the moiety; m is at least 1; q is 0 or more; and the resulting IgSF conjugate binds to the one or more counter structure ligands. In particular embodiments, m is 1 to 4 and q is 0 to 8.

In some embodiments, there is provided an IgSF conjugate comprising a variant polypeptide or immunomodulatory protein provided herein conjugated with a targeting agent that binds to a cell surface molecule, for example, for targeted delivery of the variant polypeptide or immunomodulatory protein to a specific cell. In some embodiments, the targeting agent is a molecule(s) that has the ability to localize and bind to a molecule present on a normal cell/tissue and/or tumor cell/tumor in a subject. In other words, IgSF conjugates comprising a targeting agent can bind to a ligand (directly or indirectly), which is present on a cell, such as a tumor cell. The targeting agents of the invention contemplated for use include antibodies, polypeptides, peptides, aptamers, other ligands, or any combination thereof, that can bind a component of a target cell or molecule.

In some embodiments, the targeting agent binds a tumor cell(s) or can bind in the vicinity of a tumor cell(s) (e.g., tumor vasculature or tumor microenvironment) following administration to the subject. The targeting agent may bind to a receptor or ligand on the surface of the cancer cell. In another aspect of the invention, a targeting agent is selected which is specific for a noncancerous cells or tissue. For example, a targeting agent can be specific for a molecule present normally on a particular cell or tissue. Furthermore, in some embodiments, the same molecule can be present on normal and cancer cells. Various cellular components and molecules are known. For example, if a targeting agent is specific for EGFR, the resulting IgSF conjugate can target cancer cells expressing EGFR as well as normal skin epidermal cells expressing EGFR. Therefore, in some embodiments, an IgSF conjugate of the invention can operate by two separate mechanisms (targeting cancer and non-cancer cells).

In various aspects of the invention disclosed herein an IgSF conjugate of the invention comprises a targeting agent which can bind/target a cellular component, such as a tumor antigen, a bacterial antigen, a viral antigen, a mycoplasm antigen, a fungal antigen, a prion antigen, an antigen from a parasite. In some aspects, a cellular component, antigen or molecule can each be used to mean, a desired target for a targeting agent. For example, in various embodiments, a targeting agent is specific for or binds to a component, which includes but is not limited to, epidermal growth factor receptor (EGFR, ErbB-1, HER1), ErbB-2 (HER2/neu), ErbB-3/HER3, ErbB-4/HER4, EGFR ligand family; insulin-like growth factor receptor (IGFR) family, IGF-binding proteins (IGFBPs), IGFR ligand family; platelet derived growth factor receptor (PDGFR) family, PDGFR ligand family; fibroblast growth factor receptor (FGFR) family, FGFR ligand family, vascular endothelial growth factor receptor (VEGFR) family, VEGF family; HGF receptor family; TRK receptor family; ephrin (EPH) receptor family; AXL receptor family; leukocyte tyrosine kinase (LTK) receptor family; TIE receptor family, angiopoietin 1,2; receptor tyrosine kinase-like orphan receptor (ROR) receptor family, e.g. ROR1; CD171 (L1CAM); B7-H6 (NCR3LG1); CD155, tumor glycosylation antigen, e.g. sTn or Tn, such as sTn Ag of MUC1; LHR (LHCGR); phosphatidylserine, discoidin domain receptor (DDR) family; RET receptor family; KLG receptor family; RYK receptor family; MuSK receptor family; Transforming growth factor-α (TGF-α) receptors, TGF-β; Cytokine receptors, Class I (hematopoietin family) and Class II (interferon/IL-10 family) receptors, tumor necrosis factor (TNF) receptor superfamily (TNFRSF), death receptor family; cancer-testis (CT) antigens, lineage-specific antigens, differentiation antigens, alpha-actinin-4, ARTCl, breakpoint cluster region-Abelson (Bcr-abl) fusion products, B-RAF, caspase-5 (CASP-5), caspase-8 (CASP-8), β-catenin (CTNNBl), cell division cycle 27 (CDC27), cyclin-dependent kinase 4 (CDK4), CDKN2A, COA-I, dek-can fusion protein, EFTUD-2, Elongation factor 2 (ELF2), Ets variant gene 6/acute myeloid leukemia 1 gene ETS (ETC6-AML1) fusion protein, fibronectin (FN), e.g. the extradomain A (EDA) of fibronectin, GPNMB, low density lipid receptor/GDP-L fucose: β-D-galactose 2-α-L-fucosyltransferase (LDLR/FUT) fusion protein, HLA-A2. arginine to isoleucine exchange at residue 170 of the α-helix of the α2-domain in the HLA-A2gene (HLA-A*201-R170I), HLA-Al 1, heat shock protein 70-2 mutated (HSP70-2M), K1AA0205, MART2, melanoma ubiquitous mutated 1, 2, 3 (MUM-I, 2, 3), prostatic acid phosphatase (PAP), neo-PAP, Myosin class I, NFYC, OGT, OS-9, pml-RARα fusion protein, PRDX5, PTPRK, K-ras (KRAS2), N-ras (NRAS), HRAS, RBAF600, SIRT2, SNRPD1, SYT-SSXl or -SSX2 fusion protein, Triosephosphate Isomerase, BAGE, BAGK-1, BAGE-2,3,4,5, GAGE-1,2,3,4,5,6,7,8, GnT-V (aberrant N-acetyl glucosaminyl transferase V, MGAT5), HERV-K-MEL, KK-LC, KM-HN-I, LAGE, LAGE-I, CTL-recognized antigen on melanoma (CAMEL), MAGE-A1 (MAGE-I), MAGE-A2, MAGE-A3, MAGE-A4, MAGE-A5, MAGE-A6, MAGE-A8, MAGE-A9, MAGE-AlO, MAGE-AI 1, MAGE-A12, MAGE-3, MAGE-B1, MAGE-B2, MAGE-B5, MAGE-B6, MAGE-C1, MAGE-C2, mucin 1 (MUCl), MART-1/Melan-A (MLANA), gplOO, gplOO/Pmell7 (SILV), tyrosinase (TYR), TRP-I, HAGE, NA-88, NY-ESO-I, NY-ESO-1/LAGE-2, SAGE, Spl7, SSX-1,2,3,4, TRP2-INT2, carcinoembryonic antigen (CEA), Kallikrein 4, mammaglobin-A, OAl, prostate specific antigen (PSA), TRP-1/gp75, TRP-2, adipophilin, interferon inducible protein absent in melanoma 2 (AIM-2), BING-4, CPSF, cyclin Dl, epithelial cell adhesion molecule (Ep-CAM), EphA3, fibroblast growth factor-5 (FGF-5), glycoprotein 250 (gp250), EGFR (ERBB1), HER-2/neu (ERBB2), interleukin 13 receptor α2 chain (IL13Ra2), IL-6 receptor, intestinal carboxyl esterase (iCE), alpha-feto protein (AFP), M-CSF, mdm-2, MUCI, p53 (TP53), PBF, PRAME, PSMA, RAGE-I, RNF43, RU2AS, SOX10, STEAPI, survivin (BIRC5), human telomerase reverse transcriptase (hTERT), telomerase, Wilms' tumor gene (WTl), SYCP1, BRDT, SPANX, XAGE, ADAM2, PAGE-5, LIP1, CTAGE-I, CSAGE, MMAl, CAGE, BORIS, HOM-TES-85, AF15ql4, HCA661, LDHC, MORC, SGY-I, SPOl 1, TPX1, NY-SAR-35, FTHL17, NXF2, TDRD1, TEX15, FATE, TPTE, immunoglobulin idiotypes, Bence-Jones protein, estrogen receptors (ER), androgen receptors (AR), CD40, CD30, CD20, CD 19, CD33, cancer antigen 72-4 (CA 72-4), cancer antigen 15-3 (CA 15-3), cancer antigen 27-29 (CA 27-29), cancer antigen 125 (CA 125), cancer antigen 19-9 (CA 19-9), β-human chorionic gonadotropin, β-2 microglobulin, squamous cell carcinoma antigen, neuron-specific enolase, heat shock protein gp96, GM2, sargramostim, CTLA-4, 707 alanine proline (707-AP), adenocarcinoma antigen recognized by T cells 4 (ART-4), carcinoembryogenic antigen peptide-1 (CAP-I), calcium-activated chloride channel-2 (CLCA2), cyclophilin B (Cyp-B), human signet ring tumor-2 (HST-2), Human papilloma virus (HPV) proteins (HPV-E6, HPV-E7, major or minor capsid antigens, others), Epstein-Barr virus (EBV) proteins (EBV latent membrane proteins—LMP1, LMP2; others), Hepatitis B or C virus proteins, and HIV proteins.

In some embodiments, an IgSF conjugate, through its targeting agent, will bind a cellular component of a tumor cell, tumor vasculature or tumor microenvironment, thereby promoting killing of targeted cells via modulation of the immune response, (e.g., by activation of co-stimulatory molecules or inhibition of negative regulatory molecules of immune cell activation), inhibition of survival signals (e.g., growth factor or cytokine or hormone receptor antagonists), activation of death signals, and/or immune-mediated cytotoxicity, such as through antibody dependent cellular cytotoxicity. Such IgSF conjugates can function through several mechanisms to prevent, reduce or eliminate tumor cells, such as to facilitate delivery of conjugated effector moieties to the tumor target, such as through receptor-mediated endocytosis of the IgSF conjugate; or such conjugates can recruit, bind, and/or activate immune cells (e.g. NK cells, monocytes/macrophages, dendritic cells, T cells, B cells). Moreover, in some instances one or more of the foregoing pathways may operate upon administration of one or more IgSF conjugates of the invention.

In some embodiments, an IgSF conjugate, through its targeting agent, will be localized to, such as bind to, a cellular component of a tumor cell, tumor vasculature or tumor microenvironment, thereby modulating cells of the immune response in the vicinity of the tumor. In some embodiments, the targeting agent facilitates delivery of the conjugated IgSF (e.g. vIgD) to the tumor target, such as to interact with its cognate binding partner to alter signaling of immune cells (e.g. NK cells, monocytes/macrophages, dendritic cells, T cells, B cells) bearing the cognate binding partner. In some embodiments, localized delivery mediates an antagonizing or blocking activity of the TIGIT inhibitory receptor. In some embodiments, localized delivery agonizes the TIGIT inhibitory receptor, which, in some cases, can occur where there is proximal clustering of an activating receptor.

In some embodiments, the targeting agent is an immunoglobulin. As used herein, the term "immunoglobulin" includes natural or artificial mono- or polyvalent antibodies including, but not limited to, polyclonal, monoclonal, multispecific, human, humanized or chimeric antibodies, single chain antibodies, Fab fragments, F(ab') fragments, fragments produced by a Fab expression library, single chain Fv (scFv); anti-idiotypic (anti-Id) antibodies (including, e.g., anti-Id antibodies to antibodies of the invention), and epitope-binding fragments of any of the above. The term "antibody," as used herein, refers to immunoglobulin molecules and immunologically active portions of immunoglobulin molecules, e.g., molecules that contain an antigen binding site that immunospecifically binds an antigen. The immunoglobulin molecules of the invention can be of any type (e.g., IgG, IgE, IgM, IgD, IgA, and IgY), class (e.g., IgG1, IgG2, IgG3, IgG4, IgA1, and IgA2) or subclass of immunoglobulin molecule.

In some embodiments, an IgSF conjugate, through its antibody targeting moiety, will bind a cellular component of a tumor cell, tumor vasculature or tumor microenvironment, thereby promoting apoptosis of targeted cells via modulation of the immune response, (e.g., by activation of co-stimulatory molecules or inhibition of negative regulatory molecules of immune cell activation), inhibition of survival signals (e.g., growth factor or cytokine or hormone receptor antagonists), activation of death signals, and/or immune-mediated cytotoxicity, such as through antibody dependent cellular cytotoxicity. Such IgSF conjugates can function through several mechanisms to prevent, reduce or eliminate tumor cells, such as to facilitate delivery of conjugated effector moieties to the tumor target, such as through receptor-mediated endocytosis of the IgSF conjugate; or such conjugates can recruit, bind, and/or activate immune cells (e.g. NK cells, monocytes/macrophages, dendritic cells, T cells, B cells).

In some embodiments, an IgSF conjugate, through its antibody targeting moiety, will bind a cellular component of a tumor cell, tumor vasculature or tumor microenvironment, thereby modulating the immune response (e.g., by activation of co-stimulatory molecules or inhibition of negative regulatory molecules of immune cell activation). In some embodiments, such conjugates can recognize, bind, and/or modulate (e.g. inhibit or activate) immune cells (e.g. NK cells, monocytes/macrophages, dendritic cells, T cells, B cells).

Antibody targeting moieties of the invention include antibody fragments that include, but are not limited to, Fab, Fab' and F(ab')2, Fd, single-chain Fvs (scFv), single-chain antibodies, disulfide-linked Fvs (sdFv) and fragments comprising either a $V_L$ or $V_H$ domain. Antigen-binding antibody fragments, including single-chain antibodies, may comprise the variable region(s) alone or in combination with the entirety or a portion of the following: hinge region, CH1, CH2, and CH3 domains. Also included in the invention are antigen-binding fragments also comprising any combination of variable region(s) with a hinge region, CH1, CH2, and CH3 domains. Also included in the invention are Fc fragments, antigen-Fc fusion proteins, and Fc-targeting moiety conjugates or fusion products (Fc-peptide, Fc-aptamer). The antibody targeting moieties of the invention may be from any animal origin including birds and mammals. In one aspect, the antibody targeting moieties are human, murine (e.g., mouse and rat), donkey, sheep, rabbit, goat, guinea pig, camel, horse, or chicken. Further, such antibodies may be humanized versions of animal antibodies. The antibody targeting moieties of the invention may be monospecific, bispecific, trispecific, or of greater multispecificity.

In various embodiments, an antibody/targeting moiety recruits, binds, and/or activates immune cells (e.g. NK cells, monocytes/macrophages, dendritic cells) via interactions between Fc (in antibodies) and Fc receptors (on immune cells) and via the conjugated variant polypeptides or immunomodulatory proteins provided herein. In some embodiments, an antibody/targeting moiety recognizes or binds a tumor agent via and localizes to the tumor cell the conjugated variant polypeptides or immunomodulatory proteins provided herein to facilitate modulation of immune cells in the vicinity of the tumor.

Examples of antibodies which can be incorporated into IgSF conjugates include but are not limited to antibodies such as Cetuximab (IMC-C225; Erbitux®), Trastuzumab (Herceptin®), Rituximab (Rituxan®; MabThera®), Bevacizumab (Avastin®), Alemtuzumab (Campath®; Campath-1H®; Mabcampath®), Panitumumab (ABX-EGF; Vectibix®), Ranibizumab (Lucentis®), Ibritumomab, Ibritumomab tiuxetan, (Zevalin @), Tositumomab, Iodine 1131 Tositumomab (BEXXAR®), Catumaxomab (Removab®), Gemtuzumab, Gemtuzumab ozogamicine (Mylotarg®), Abatacept (CTLA4-Ig; Orencia®), Belatacept (L104EA29YIg; LEA29Y; LEA), Ipilimumab (MDX-010; MDX-101), Tremelimumab (ticilimumab; CP-675,206), PRS-010, PRS-050, Aflibercept (VEGF Trap, AVE005), Volociximab (M200), F200, MORAb-009, SS1P (CAT-5001), Cixutumumab (IMC-A12), Matuzumab (EMD72000), Nimotuzumab (h-R3), Zalutumumab (HuMax-EGFR), Necitumumab IMC-11F8, mAb806/ch806, Sym004, mAb-425, Panorex @ (17-1A) (murine monoclonal antibody); Panorex @ (17-1A) (chimeric murine monoclonal antibody); IDEC-Y2B8 (murine, anti-CD20 MAb); BEC2 (anti-idiotypic MAb, mimics the GD epitope) (with BCG); Oncolym (Lym-1 monoclonal antibody); SMART MI95 Ab, humanized 13' I LYM-I (Oncolym), Ovarex (B43.13, anti-idiotypic mouse MAb); MDX-210 (humanized anti-HER-2 bispecific antibody); 3622W94 MAb that binds to EGP40 (17-1A) pancarcinoma antigen on adenocarcinomas; Anti-VEGF, Zenapax (SMART Anti-Tac (IL-2 receptor); SMART MI95 Ab, humanized Ab, humanized); MDX-210 (humanized anti-HER-2 bispecific antibody); MDX-447 (humanized anti-EGF receptor bispecific antibody); NovoMAb-G2 (pancarcinoma specific Ab); TNT (chimeric MAb to histone antigens); TNT (chimeric MAb to histone antigens); Gliomab-H (Monoclon s—Humanized Abs); GNI-250 Mab; EMD-72000 (chimeric-EGF antagonist); LymphoCide (humanized LL2 antibody); and MDX-260 bispecific, targets GD-2, ANA Ab, SMART IDIO Ab, SMART ABL 364 Ab or ImmuRAIT-CEA. As illustrated by the forgoing list, it is conventional to make antibodies to a particular target epitope.

In some embodiments, the antibody targeting moiety is a full length antibody, or antigen-binding fragment thereof, containing an Fe domain. In some embodiments, the variant polypeptide or immunomodulatory protein is conjugated to the Fc portion of the antibody targeting moiety, such as by conjugation to the N-terminus of the Fc portion of the antibody.

Figures 7A, 7B:
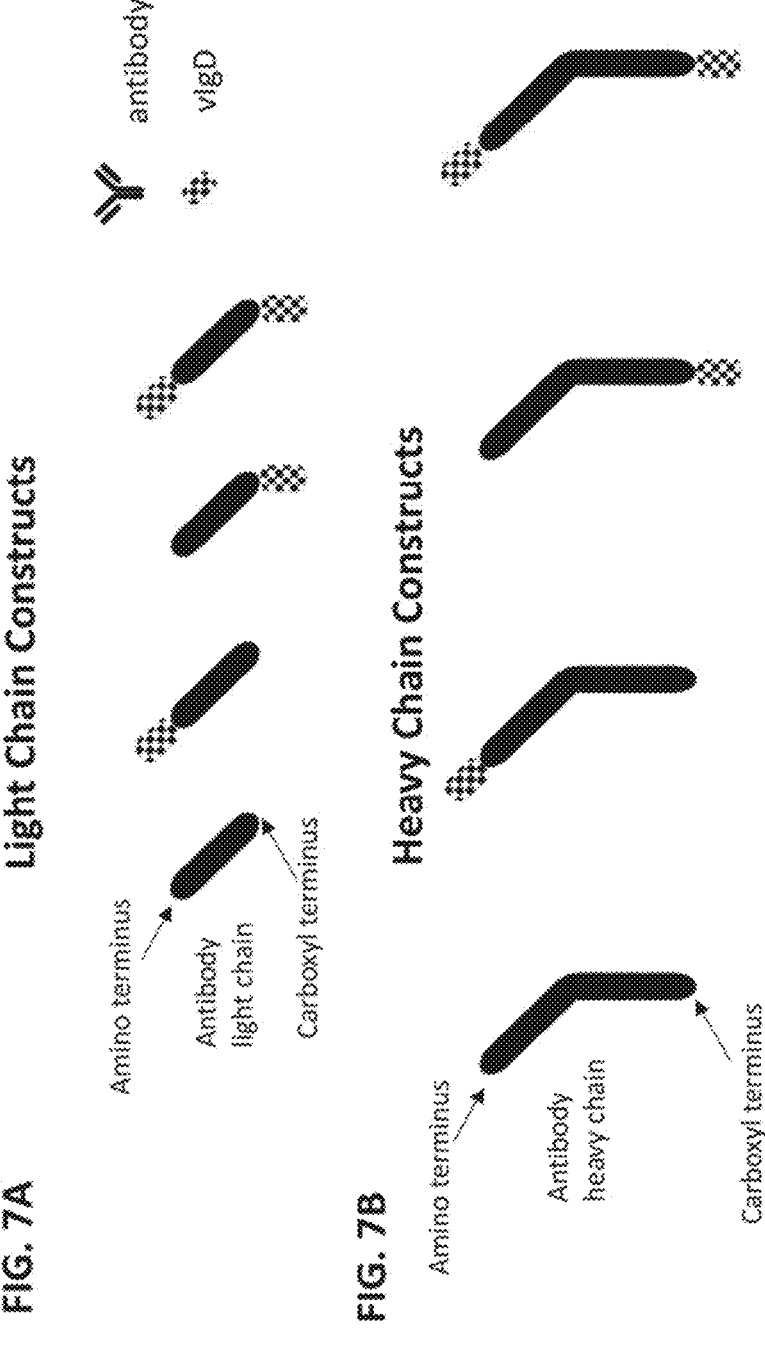
FIGS. 7A-7C depict various exemplary configurations of a variant IgSF-antibody conjugate (V-Mab).
Figure 7C:
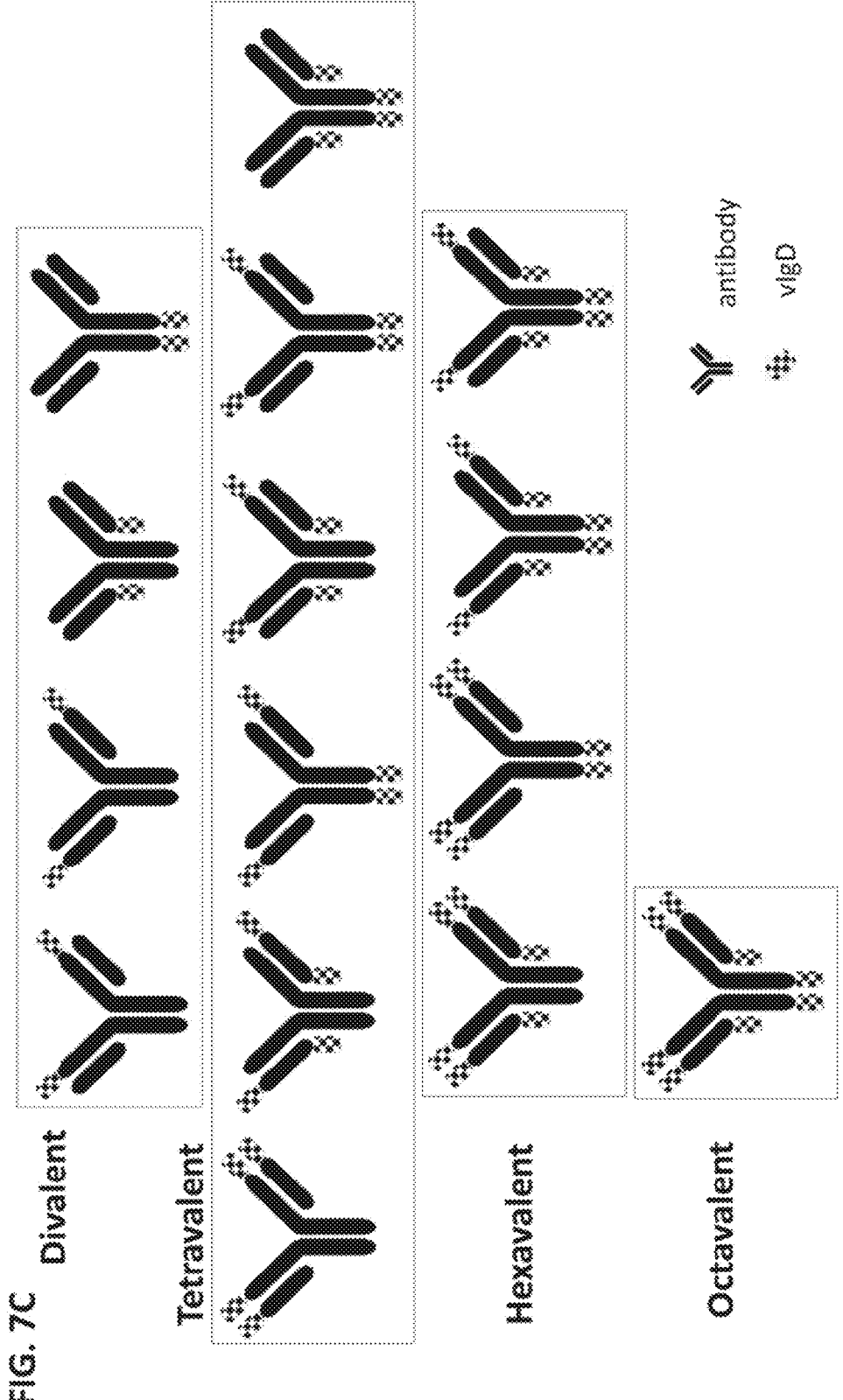

In some embodiments, the vIgD is linked, directly or indirectly, to the N- or C-terminus of the light and/or heavy chain of the antibody. In some embodiments, linkage can be via a peptide linker, such as any described above. Various configurations can be constructed. FIG. 7A-7C depict exemplary configurations. In some embodiments, the antibody conjugate can be produced by co-expression of the heavy and light chain of the antibody in a cell.

In one aspect of the invention, the targeting agent is an aptamer molecule. For example, in some embodiments, the aptamer is comprised of nucleic acids that function as a targeting agent. In various embodiments, an IgSF conjugate of the invention comprises an aptamer that is specific for a molecule on a tumor cell, tumor vasculature, and/or a tumor microenvironment. In some embodiments, the aptamer itself can comprise a biologically active sequence, in addition to the targeting module (sequence), wherein the biologically active sequence can induce an immune response to the target cell. In other words, such an aptamer molecule is a dual use agent. In some embodiments, an IgSF conjugate of the invention comprises conjugation of an aptamer to an antibody, wherein the aptamer and the antibody are specific for binding to separate molecules on a tumor cell, tumor vasculature, tumor microenvironment, and/or immune cells.

The term "aptamer" includes DNA, RNA or peptides that are selected based on specific binding properties to a particular molecule. For example, an aptamer(s) can be selected for binding a particular gene or gene product in a tumor cell, tumor vasculature, tumor microenvironment, and/or an immune cell, as disclosed herein, where selection is made by methods known in the art and familiar to one of skill in the art.

In some aspects of the invention the targeting agent is a peptide. For example, the variant polypeptides or immunomodulatory proteins provided herein can be conjugated to a peptide which can bind with a component of a cancer or tumor cells. Therefore, such IgSF conjugates of the invention comprise peptide targeting agents which binds to a cellular component of a tumor cell, tumor vasculature, and/or a component of a tumor microenvironment. In some embodiments, targeting agent peptides can be an antagonist or agonist of an integrin. Integrins, which comprise an alpha and a beta subunit, include numerous types well known to a skilled artisan.

In one embodiment, the targeting agent is Vvβ3. Integrin Vvβ3 is expressed on a variety of cells and has been shown to mediate several biologically relevant processes, including adhesion of osteoclasts to bone matrix, migration of vascular smooth muscle cells, and angiogenesis. Suitable targeting molecules for integrins include RGD peptides or peptidomimetics as well as non-RGD peptides or peptidomimetics (see, e.g., U.S. Pat. Nos. 5,767,071 and 5,780,426) for other integrins such as V4.βi (VLA-4), V4-P7 (see, e.g., U.S. Pat. No. 6,365,619; Chang et al, Bioorganic & Medicinal Chem Lett, 12:159-163 (2002); Lin et al., Bioorganic & Medicinal Chem Lett, 12:133-136 (2002)), and the like.

In some embodiments, there is provided an IgSF conjugate comprising a variant polypeptide or immunomodulatory protein provided herein conjugated with a therapeutic agent. In some embodiments, the therapeutic agent includes, for example, daunomycin, doxorubicin, methotrexate, and vindesine (Rowland et al., Cancer Immunol. Immunother. 21:183-187, 1986). In some embodiments, the therapeutic agent has an intracellular activity. In some embodiments, the IgSF conjugate is internalized and the therapeutic agent is a cytotoxin that blocks the protein synthesis of the cell, therein leading to cell death. In some embodiments, the therapeutic agent is a cytotoxin comprising a polypeptide having ribosome-inactivating activity including, for example, gelonin, bouganin, saporin, ricin, ricin A chain, bryodin, diphtheria toxin, restrictocin, *Pseudomonas* exotoxin A and variants thereof. In some embodiments, where the therapeutic agent is a cytotoxin comprising a polypeptide having a ribosome-inactivating activity, the IgSF conjugate must be internalized upon binding to the target cell in order for the protein to be cytotoxic to the cells.

In some embodiments, there is provided an IgSF conjugate comprising a variant polypeptide or immunomodulatory protein provided herein conjugated with a toxin. In some embodiments, the toxin includes, for example, bacterial toxins such as diphtheria toxin, plant toxins such as ricin, small molecule toxins such as geldanamycin (Mandler et al., J. Nat. Cancer Inst. 92(19):1573-1581 (2000); Mandler et al., Bioorganic & Med. Chem. Letters 10:1025-1028 (2000); Mandler et al., Bioconjugate Chem. 13:786-791 (2002)), maytansinoids (EP 1391213; Liu et al., Proc. Natl. Acad. Sci. USA 93:8618-8623 (1996)), and calicheamicin (Lode et al., Cancer Res. 58:2928 (1998); Hinman et al., Cancer Res. 53:3336-3342 (1993)). The toxins may exert their cytotoxic and cytostatic effects by mechanisms including tubulin binding, DNA binding, or topoisomerase inhibition.

In some embodiments, there is provided an IgSF conjugate comprising a variant polypeptide or immunomodulatory protein provided herein conjugated with a label, which can generate a detectable signal, indirectly or directly. These IgSF conjugates can be used for research or diagnostic applications, such as for the in vivo detection of cancer. The label is preferably capable of producing, either directly or indirectly, a detectable signal. For example, the label may be radio-opaque or a radioisotope, such as 3H, 14C, 32P, 35S, 1231, 1251, 1311; a fluorescent (fluorophore) or chemiluminescent (chromophore) compound, such as fluorescein isothiocyanate, rhodamine or luciferin; an enzyme, such as alkaline phosphatase, β-galactosidase or horseradish peroxidase; an imaging agent; or a metal ion. In some embodiments, the label is a radioactive atom for scintigraphic studies, for example 99Tc or 1231, or a spin label for nuclear magnetic resonance (NMR) imaging (also known as magnetic resonance imaging, MRI), such as zirconium-89, iodine-123, iodine-131, indium-111, fluorine-19, carbon-13, nitrogen-15, oxygen-17, gadolinium, manganese or iron. Zirconium-89 may be complexed to various metal chelating agents and conjugated to antibodies, e.g., for PET imaging (WO 2011/056983). In some embodiments, the IgSF conjugate is detectable indirectly. For example, a secondary antibody that is specific for the IgSF conjugate and contains a detectable label can be used to detect the IgSF conjugate.

The IgSF conjugates may be prepared using any methods known in the art. See, e.g., WO 2009/067800, WO 2011/133886, and U.S. Patent Application Publication No. 2014322129, incorporated by reference herein in their entirety.

The variant polypeptides or immunomodulatory proteins of an IgSF conjugate may be "attached to" the effector moiety by any means by which the variant polypeptides or immunomodulatory proteins can be associated with, or linked to, the effector moiety. For example, the variant polypeptides or immunomodulatory proteins of an IgSF conjugate may be attached to the effector moiety by chemical or recombinant means. Chemical means for preparing fusions or conjugates are known in the art and can be used to prepare the IgSF conjugate. The method used to conjugate the variant polypeptides or immunomodulatory proteins and effector moiety must be capable of joining the variant polypeptides or immunomodulatory proteins with the effector moiety without interfering with the ability of the variant polypeptides or immunomodulatory proteins to bind to their one or more counter structure ligands.

The variant polypeptides or immunomodulatory proteins of an IgSF conjugate may be linked indirectly to the effector moiety. For example, the variant polypeptides or immunomodulatory proteins of an IgSF conjugate may be directly linked to a liposome containing the effector moiety of one of several types. The effector moiety(s) and/or the variant polypeptides or immunomodulatory proteins may also be bound to a solid surface.

In some embodiments, the variant polypeptides or immunomodulatory proteins of an IgSF conjugate and the effector moiety are both proteins and can be conjugated using techniques well known in the art. There are several hundred crosslinkers available that can conjugate two proteins. (See for example "Chemistry of Protein Conjugation and Cross-linking," 1991, Shans Wong, CRC Press, Ann Arbor). The crosslinker is generally chosen based on the reactive functional groups available or inserted on the variant polypeptides or immunomodulatory proteins and/or effector moiety. In addition, if there are no reactive groups, a photoactivatible crosslinker can be used. In certain instances, it may be desirable to include a spacer between the variant polypeptides or immunomodulatory proteins and the effector moiety. Crosslinking agents known to the art include the homobifunctional agents: glutaraldehyde, dimethyladipimidate and Bis(diazobenzidine) and the heterobifunctional agents: m Maleimidobenzoyl-N-Hydroxysuccinimide and Sulfo-m Maleimidobenzoyl-N-Hydroxysuccinimide.

In some embodiments, the variant polypeptides or immunomodulatory proteins of an IgSF conjugate may be engineered with specific residues for chemical attachment of the effector moiety. Specific residues used for chemical attachment of molecule known to the art include lysine and cysteine. The crosslinker is chosen based on the reactive functional groups inserted on the variant polypeptides or immunomodulatory proteins, and available on the effector moiety.

An IgSF conjugate may also be prepared using recombinant DNA techniques. In such a case a DNA sequence encoding the variant polypeptides or immunomodulatory proteins is fused to a DNA sequence encoding the effector moiety, resulting in a chimeric DNA molecule. The chimeric DNA sequence is transfected into a host cell that expresses the fusion protein. The fusion protein can be recovered from the cell culture and purified using techniques known in the art.

Examples of attaching an effector moiety, which is a label, to the variant polypeptides or immunomodulatory proteins include the methods described in Hunter, et al., Nature 144:945 (1962); David, et al., Biochemistry 13:1014 (1974); Pain, et al., J. Immunol. Meth. 40:219 (1981); Nygren, J. Histochem. and Cytochem. 30:407 (1982); Wensel and Meares, Radioimmunoimaging And Radioimmunotherapy, Elsevier, N.Y. (1983); and Colcher et al., "Use Of Monoclonal Antibodies As Radiopharmaceuticals For The Localization Of Human Carcinoma Xenografts In Athymic Mice", Meth. Enzymol., 121:802-16 (1986).

The radio- or other labels may be incorporated in the conjugate in known ways. For example, the peptide may be biosynthesized or may be synthesized by chemical amino acid synthesis using suitable amino acid precursors involving, for example, fluorine-19 in place of hydrogen. Labels such as 99Tc or 123I, 186Re, 188Re and 111In can be attached via a cysteine residue in the peptide. Yttrium-90 can be attached via a lysine residue. The IODOGEN method (Fraker et al., Biochem. Biophys. Res. Commun. 80:49-57 (1978)) can be used to incorporate iodine-123. "Monoclonal Antibodies in Immunoscintigraphy" (Chatal, CRC Press 1989) describes other methods in detail.

Conjugates of the variant polypeptides or immunomodulatory proteins and a cytotoxic agent may be made using a variety of bifunctional protein coupling agents such as N-succinimidyl-3-(2-pyridyldithio) propionate (SPDP), succinimidyl-4-(N-maleimidomethyl) cyclohexane-1-carboxylate (SMCC), iminothiolane (IT), bifunctional derivatives of imidoesters (such as dimethyl adipimidate HCl), active esters (such as disuccinimidyl suberate), aldehydes (such as glutaraldehyde), bis-azido compounds (such as bis (p-azidobenzoyl) hexanediamine), bis-diazonium derivatives (such as bis-(p-diazoniumbenzoyl)-ethylenediamine), diisocyanates (such as toluene 2,6-diisocyanate), and bis-active fluorine compounds (such as 1,5-difluoro-2,4-dinitrobenzene). For example, a ricin immunotoxin can be prepared as described in Vitetta et al., Science 238:1098 (1987). Carbon-14-labeled 1-p-isothiocyanatobenzyl-3-methyldiethylenetriaminepentaacetic acid (MX-DTPA) is an exemplary chelating agent for conjugation of radionucleotide to the antibody. See, e.g., WO94/11026. The linker may be a "cleavable linker" facilitating release of the cytotoxic drug in the cell. For example, an acid-labile linker, peptidase-sensitive linker, photolabile linker, dimethyl linker or disulfide-containing linker (Chari et al., Cancer Research 52:127-131 (1992); U.S. Pat. No. 5,208,020) may be used.

The IgSF conjugates of the invention expressly contemplate, but are not limited to, drug conjugates prepared with cross-linker reagents: BMPS, EMCS, GMBS, HBVS, LC-SMCC, MBS, MPBH, SBAP, SIA, SIAB, SMCC, SMPB, SMPH, sulfo-EMCS, sulfo-GMBS, sulfo-KMUS, sulfo-MBS, sulfo-SIAB, sulfo-SMCC, and sulfo-SMPB, and SVSB (succinimidyl-(4-vinylsulfone)benzoate) which are commercially available (e.g., from Pierce Biotechnology, Inc., Rockford, IL, U.S.A). See pages 467-498, 2003-2004 Applications Handbook and Catalog.

D. Transmembrane and Secretable Immunomodulatory Proteins and Engineered Cells

Provided herein are engineered cells which express the immunomodulatory variant CD155 polypeptides (alternatively, "engineered cells"). In some embodiments, the expressed immunomodulatory variant CD155 polypeptide is a transmembrane proteins and is surface expressed. In some embodiments, the expressed immunomodulatory variant CD155 polypeptide is expressed and secreted from the cell.

1. Transmembrane Immunomodulatory Proteins

In some embodiments, an immunomodulatory polypeptide comprising a variant CD155 can be a membrane bound protein. As described in more detail below, the immunomodulatory polypeptide can be a transmembrane immunomodulatory polypeptide comprising a variant CD155 in which is contained: an ectodomain containing at least one affinity modified IgSF domain (IgV or IgC), a transmembrane domain and, optionally, a cytoplasmic domain. In some embodiments, the transmembrane immunomodulatory protein can be expressed on the surface of an immune cell, such as a mammalian cell, including on the surface of a lymphocyte (e.g. T cell or NK cell) or antigen presenting cell. In some embodiments, the transmembrane immunomodulatory protein is expressed on the surface of a mammalian T-cell, including such T-cells as: a T helper cell, a cytotoxic T-cell (alternatively, cytotoxic T lymphocyte or CTL), a natural killer T-cell, a regulatory T-cell, a memory T-cell, or a gamma delta T-cell. In some embodiments, the mammalian cell is an antigen presenting cell (APC). Typically, but not exclusively, the ectodomain (alternatively, "extracellular domain") of comprises the one or more amino acid variations (e.g. amino acid substitutions) of the variant CD155 of the invention. Thus, for example, in some embodiments a transmembrane protein will comprise an ectodomain that comprises one or more amino acid substitutions of a variant CD155 of the invention.

In some embodiments, the engineered cells express a variant CD155 polypeptides are transmembrane immunomodulatory polypeptides (TIPs) that can be a membrane protein such as a transmembrane protein. In typical embodiments, the ectodomain of a membrane protein comprises an extracellular domain or IgSF domain thereof of a variant CD155 provided herein in which is contained one or more amino acid substitutions in at least one IgSF domain as described. The transmembrane immunomodulatory proteins provided herein further contain a transmembrane domain linked to the ectodomain. In some embodiments, the transmembrane domain results in an encoded protein for cell surface expression on a cell. In some embodiments, the transmembrane domain is linked directly to the ectodomain. In some embodiments, the transmembrane domain is linked indirectly to the ectodomain via one or more linkers or spacers. In some embodiments, the transmembrane domain contains predominantly hydrophobic amino acid residues, such as leucine and valine.

In some embodiments, a full length transmembrane anchor domain can be used to ensure that the TIPs will be expressed on the surface of the engineered cell, such as engineered T cell. Conveniently, this could be from a particular native protein that is being affinity modified (e.g. CD155 or other native IgSF protein), and simply fused to the sequence of the first membrane proximal domain in a similar fashion as the native IgSF protein (e.g. CD155). In some embodiments, the transmembrane immunomodulatory protein comprises a transmembrane domain of the corresponding wild-type or unmodified IgSF member, such as a transmembrane domain contained in the sequence of amino acids set forth in SEQ ID NO:20 (Table 2). In some embodiments, the membrane bound form comprises a transmembrane domain of the corresponding wild-type or unmodified polypeptide, such as corresponding to residues 221-241 of SEQ ID NO:20.

In some embodiments, the transmembrane domain is a non-native transmembrane domain that is not the transmembrane domain of native CD155. In some embodiments, the transmembrane domain is derived from a transmembrane domain from another non-CD155 family member polypeptide that is a membrane-bound or is a transmembrane protein. In some embodiments, a transmembrane anchor domain from another protein on T cells can be used. In some embodiments, the transmembrane domain is derived from CD8. In some embodiments, the transmembrane domain can further contain an extracellular portion of CD8 that serves as a spacer domain. An exemplary CD8 derived transmembrane domain is set forth in SEQ ID NO: 130 or 1142 or a portion thereof containing the CD8 transmembrane domain. In some embodiments, the transmembrane domain is a synthetic transmembrane domain.

In some embodiments, the transmembrane immunomodulatory protein further contains an endodomain, such as a cytoplasmic signaling domain, linked to the transmembrane domain. In some embodiments, the cytoplasmic signaling domain induces cell signaling. In some embodiments, the endodomain of the transmembrane immunomodulatory protein comprises the cytoplasmic domain of the corresponding wild-type or unmodified polypeptide, such as a cytoplasmic domain contained in the sequence of amino acids set forth in SEQ ID NO:20 (see Table 2).

In some embodiments, a provided transmembrane immunomodulatory protein that is or comprises a variant CD155 comprises a sequence of amino acids that exhibits at least 85%, 86%, 87%, 88%, 89%, 90%, 91%, 92%, 93%, 94%, 95%, 96%, 97%, 98% or 99% sequence identity to SEQ ID NO: 122 and contains an ectodomain comprising at least one affinity-modified CD155 IgSF domain as described and a transmembrane domain. In some embodiments, the transmembrane immunomodulatory protein contains any one or more amino acid substitutions in an IgSF domain (e.g. IgV domain) as described, including any set forth in Table 1. In some embodiments, the transmembrane immunomodulatory protein can further comprise a cytoplasmic domain as described. In some embodiments, the transmembrane immunomodulatory protein can further contain a signal peptide. In some embodiments, the signal peptide is the native signal peptide of wild-type IgSF member, such as contained in the sequence of amino acids set forth in SEQ ID NO:20 (see e.g. Table 2).

Also provided is a nucleic acid molecule encoding such transmembrane immunomodulatory proteins. In some embodiments, a nucleic acid molecule encoding a transmembrane immunomodulatory protein comprises a nucleotide sequence that encodes a sequence of amino acids that exhibits at least 85%, 86%, 87%, 88%, 89%, 90%, 91%, 92%, 93%, 94%, 95%, 96%, 97%, 98% or 99% sequence identity to SEQ ID NOS: 122 and contains an ectodomain comprising at least one affinity-modified IgSF domain as described, a transmembrane domain and, optionally, a cytoplasmic domain. In some embodiments, the nucleic acid molecule can further comprise a sequence of nucleotides encoding a signal peptide. In some embodiments, the signal peptide is the native signal peptide of the corresponding wild-type IgSF member (see e.g. Table 2).

In some embodiments, provided are CAR-related transmembrane immunomodulatory proteins in which the endodomain of a transmembrane immunomodulatory protein comprises a cytoplasmic signaling domain that comprises at least one ITAM (immunoreceptor tyrosine-based activation motif)-containing signaling domain. ITAM is a conserved motif found in a number of protein signaling domains involved in signal transduction of immune cells, including in the CD3-zeta chain ("CD3-z") involved in T-cell receptor signal transduction. In some embodiments, the endodomain comprises at CD3-zeta signaling domain. In some embodiments, the CD3-zeta signaling domain comprises the sequence of amino acids set forth in SEQ ID NO: 131 or a sequence of amino acids that exhibits at least 85%, 86%, 87%, 88%, 89%, 90%, 91%, 92%, 93%, 94%, 95%, 96%, 97%, 98% or 99% to SEQ ID NO:131 and retains the activity of T cell signaling. In some embodiments, the endodomain of a CAR-related transmembrane immunomodulatory protein can further comprise a costimulatory signaling domain to further modulate immunomodulatory responses of the T-cell. In some embodiments, the costimulatory signaling domain is CD28, ICOS, 41BB or OX40. In some embodiments, the costimulatory signaling domain is a derived from CD28 or 4-1BB and comprises the sequence of amino acids set forth in any of SEQ ID NOS: 1143-1146 or a sequence of amino acids that exhibits at least 85%, 86%, 87%, 88%, 89%, 90%, 91%, 92%, 93%, 94%, 95%, 96%, 97%, 98% or 99% to SEQ ID NO:1143-1146 and retains the activity of T cell costimulatory signaling. In some embodiments, the provided CAR-related transmembrane immunomodulatory proteins have features of CARs to stimulate T cell signaling upon binding of an affinity modified IgSF domain to a cognate binding partner or counter structure. In some embodiments, upon specific binding by the affinity-modified IgSF domain to its counter structure can lead to changes in the immunological activity of the T-cell activity as reflected by changes in cytotoxicity, proliferation or cytokine production.

In some embodiments, the transmembrane immunomodulatory protein does not contain an endodomain capable of mediating cytoplasmic signaling. In some embodiments, the transmembrane immunomodulatory protein lacks the signal transduction mechanism of the wild-type or unmodified polypeptide and therefore does not itself induce cell signaling. In some embodiments, the transmembrane immuno-modulatory protein lacks an intracellular (cytoplasmic) domain or a portion of the intracellular domain of the corresponding wild-type or unmodified polypeptide, such as a cytoplasmic signaling domain contained in the sequence of amino acids set forth in SEQ ID NO:20 (see Table 2). In some embodiments, the transmembrane immunomodulatory protein does not contain an ITIM (immunoreceptor tyrosine-based inhibition motif), such as contained in certain inhibitory receptors, including inhibitory receptors of the IgSF family (e.g. TIGIT or TIGIT). Thus, in some embodiments, the transmembrane immunomodulatory protein only contains the ectodomain and the transmembrane domain, such as any as described.

2. Secreted Immunomodulatory Proteins and Engineered Cells

In some embodiments, the CD155 variant immunomodulatory polypeptide containing any one or more of the amino acid mutations as described herein, is secretable, such as when expressed from a cell. Such a variant CD155 immunomodulatory protein does not comprise a transmembrane domain. In some embodiments, the variant CD155 immunomodulatory protein is not conjugated to a half-life extending moiety (such as an Fc domain or a multimerization domain). In some embodiments, the variant CD155 immunomodulatory protein comprises a signal peptide, e.g. an antibody signal peptide or other efficient signal sequence to get domains outside of cell. When the immunomodulatory protein comprises a signal peptide and is expressed by an engineered cell, the signal peptide causes the immunomodulatory protein to be secreted by the engineered cell. Generally, the signal peptide, or a portion of the signal peptide, is cleaved from the immunomodulatory protein with secretion. The immunomodulatory protein can be encoded by a nucleic acid (which can be part of an expression vector). In some embodiments, the immunomodulatory protein is expressed and secreted by a cell (such as an immune cell, for example a primary immune cell).

Thus, in some embodiments, there are provided variant CD155 immunomodulatory proteins that further comprise a signal peptide. In some embodiments, provided herein is a nucleic acid molecule encoding the variant CD155 immunomodulatory protein operably connected to a secretion sequence encoding the signal peptide.

A signal peptide is a sequence on the N-terminus of an immunomodulatory protein that signals secretion of the immunomodulatory protein from a cell. In some embodiments, the signal peptide is about 5 to about 40 amino acids in length (such as about 5 to about 7, about 7 to about 10, about 10 to about 15, about 15 to about 20, about 20 to about 25, or about 25 to about 30, about 30 to about 35, or about 35 to about 40 amino acids in length).

In some embodiments, the signal peptide is a native signal peptide from the corresponding wild-type CD155 (see Table 2). In some embodiments, the signal peptide is a non-native signal peptide. For example, in some embodiments, the non-native signal peptide is a mutant native signal peptide from the corresponding wild-type CD155, and can include one or more (such as 2, 3, 4, 5, 6, 7, 8, 9, or 10 or more) substitutions insertions or deletions. In some embodiments, the non-native signal peptide is a signal peptide or mutant thereof of a family member from the same gSF family as the wild-type IgSF family member. In some embodiments, the non-native signal peptide is a signal peptide or mutant thereof from an gSF family member from a different IgSF family that the wild-type IgSF family member. In some embodiments, the signal peptide is a signal peptide or mutant thereof from a non-IgSF protein family, such as a signal peptide from an immunoglobulin (such as IgG heavy chain or IgG-kappa light chain), a cytokine (such as interleukin-2 (IL-2), or CD33), a serum albumin protein (e.g. HSA or albumin), a human azurocidin preprotein signal sequence, a luciferase, a trypsinogen (e.g. chymotrypsinogen or trypsinogen) or other signal peptide able to efficiently secrete a protein from a cell. Exemplary signal peptides include any described in the Table 9.

TABLE 9

| Exemplary Signal Peptides | | |
|---|---|---|
| SEQ ID NO | Signal Peptide | Peptide Sequence |
| SEQ ID NO: 137 | HSA signal peptide | MKWVTFISLLFLFSSAYS |
| SEQ ID NO: 138 | Ig kappa light chain | MDMRAPAGIFGFLLVLFPGYRS |
| SEQ ID NO: 139 | human azurocidin preprotein signal sequence | MTRLTVLALLAGLLASSRA |
| SEQ ID NO: 140 | IgG heavy chain signal peptide | MELGLSWIFLLAILKGVQC |
| SEQ ID NO: 141 | IgG heavy chain signal peptide | MELGLRWVFLVAILEGVQC |
| SEQ ID NO: 142 | IgG heavy chain signal peptide | MKHLWFFLLLVAAPRWVLS |
| SEQ ID NO: 143 | IgG heavy chain signal peptide | MDWTWRILFLVAAATGAHS |
| SEQ ID NO: 144 | IgG heavy chain signal peptide | MDWTWRFLFVVAAATGVQS |
| SEQ ID NO: 145 | IgG heavy chain signal peptide | MEFGLSWLFLVAILKGVQC |
| SEQ ID NO: 146 | IgG heavy chain signal peptide | MEFGLSWVFLVALFRGVQC |
| SEQ ID NO: 147 | IgG heavy chain signal peptide | MDLLHKNMKHLWFFLLLVAAPRWVLS |
| SEQ ID NO: 148 | IgG Kappa light chain signal sequences: | MDMRVPAQLLGLLLLWLSGARC |
| SEQ ID NO: 149 | IgG Kappa light chain signal sequences: | MKYLLPTAAAGLLLLAAQPAMA |

TABLE 9-continued

Exemplary Signal Peptides

| SEQ ID NO | Signal Peptide | Peptide Sequence |
|---|---|---|
| SEQ ID NO: 150 | Gaussia luciferase | MGVKVLFALICIAVAEA |
| SEQ ID NO: 151 | Human albumin | MKWVTFISLLFLFSSAYS |
| SEQ ID NO: 152 | Human chymotrypsinogen | MAFLWLLSCWALLGTTFG |
| SEQ ID NO: 153 | Human interleukin-2 | MQLLSCIALILALV |
| SEQ ID NO: 154 | Human trypsinogen-2 | MNLLLILTFVAAAVA |

In some embodiments of a secretable variant CD155 immunomodulatory protein, the immunomodulatory protein comprises a signal peptide when expressed, and the signal peptide (or a portion thereof) is cleaved from the immunomodulatory protein upon secretion.

In some embodiments, the engineered cells express a variant CD155 polypeptides that are secreted from the cell. In some embodiments, such a variant CD155 polypeptide is encoded by a nucleic acid molecule encoding an immunomodulatory protein under the operable control of a signal sequence for secretion. In some embodiments, the encoded immunomodulatory protein is secreted when expressed from a cell. In some embodiments, the immunomodulatory protein encoded by the nucleic acid molecule does not comprise a transmembrane domain. In some embodiments, the immunomodulatory protein encoded by the nucleic acid molecule does not comprise a half-life extending moiety (such as an Fc domain or a multimerization domain). In some embodiments, the immunomodulatory protein encoded by the nucleic acid molecule comprises a signal peptide. In some embodiments, a nucleic acid of the invention further comprises nucleotide sequence that encodes a secretory or signal peptide operably linked to the nucleic acid encoding the immunomodulatory protein, thereby allowing for secretion of the immunomodulatory protein 3. Cells and Engineering Cells Provided herein are engineered cells expressing any of the provided immunomodulatory polypeptides. In some embodiments, the engineered cells express on their surface any of the provided transmembrane immunomodulatory polypeptides. In some embodiments, the engineered cells express and are capable of or are able to secrete the immunomodulatory protein from the cells under conditions suitable for secretion of the protein. In some embodiments, the immunomodulatory protein is expressed on or in a lymphocyte such as a tumor infiltrating lymphocyte (TIL), T-cell or NK cell, or on a myeloid cell. In some embodiments, the engineered cells are antigen presenting cells (APCs). In some embodiments, the engineered cells are engineered mammalian T-cells or engineered mammalian antigen presenting cells (APCs). In some embodiments, the engineered T-cells or APCs are human or murine cells.

In some embodiments, engineered T-cells include, but are not limited to, T helper cell, cytotoxic T-cell (alternatively, cytotoxic T lymphocyte or CTL), natural killer T-cell, regulatory T-cell, memory T-cell, or gamma delta T-cell. In some embodiments, the engineered T cells are CD4+ or CD8+.

In some embodiments, the engineered APCs include, for example, MHC II expressing APCs such as macrophages, B cells, and dendritic cells, as well as artificial APCs (aAPCs) including both cellular and acellular (e.g., biodegradable polymeric microparticles) aAPCs. Artificial APCs (aAPCs) are synthetic versions of APCs that can act in a similar manner to APCs in that they present antigens to T-cells as well as activate them. Antigen presentation is performed by the MHC (Class I or Class II). In some embodiments, in engineered APCs such as aAPCs, the antigen that is loaded onto the MHC is, in some embodiments, a tumor specific antigen or a tumor associated antigen. The antigen loaded onto the MHC is recognized by a T-cell receptor (TCR) of a T cell, which, in some cases, can express TIGIT or other molecule recognized by the variant CD155 polypeptides provided herein. Materials which can be used to engineer an aAPC include: poly (glycolic acid), poly(lactic-co-glycolic acid), iron-oxide, liposomes, lipid bilayers, sepharose, and polystyrene.

In some embodiments a cellular aAPC can be engineered to contain a TIP and TCR agonist which is used in adoptive cellular therapy. In some embodiments, a cellular aAPC can be engineered to contain a TIP and TCR agonist which is used in ex vivo expansion of human T cells, such as prior to administration, e.g. for reintroduction into the patient. In some aspects, the aAPC may include expression of at least one anti-CD3 antibody clone, e.g. such as, for example, OKT3 and/or UCHT1. In some aspects, the aAPCs may be inactivated (e.g. irradiated). In some embodiment, the TIP can include any variant IgSF domain that exhibits binding affinity for a cognate binding partner on a T cell.

In some embodiments, an immunomodulatory protein provided herein, such as a transmembrane immunomodulatory protein or a secretable immunomodulatory protein, is co-expressed or engineered into a cell that expresses an antigen-binding receptor, such as a recombinant receptor, such as a chimeric antigen receptor (CAR) or T cell receptor (TCR). In some embodiments, the engineered cell, such as an engineered T cell, recognizes a desired antigen associated with cancer, inflammatory and autoimmune disorders, or a viral infection. In specific embodiments, the antigen-binding receptor contains an antigen-binding moiety that specifically binds a tumor specific antigen or a tumor associated antigen. In some embodiments, the engineered T-cell is a CAR (chimeric antigen receptor) T-cell that contains an antigen-binding domain (e.g. scFv) that specifically binds to an antigen, such as a tumor specific antigen or tumor associated antigen. In some embodiments, the TIP protein is expressed in an engineered T-cell receptor cell or an engineered chimeric antigen receptor cell. In such embodiments, the engineered cell co-expresses the TIP and the CAR or TCR. In some embodiments, the SIP protein is expressed in an engineered T-cell receptor cell or an engineered chimeric antigen receptor cell. In such embodiments, the engineered cell co-expresses the SIP and the CAR or TCR.

Chimeric antigen receptors (CARs) are recombinant receptors that include an antigen-binding domain (ectodomain), a transmembrane domain and an intracellular signaling region (endodomain) that is capable of inducing or mediating an activation signal to the T cell after the antigen is bound. In some example, CAR-expressing cells are engineered to express an extracellular single chain variable fragment (scFv) with specificity for a particular tumor antigen linked to an intracellular signaling part comprising an activating domain and, in some cases, a costimulatory domain. The costimulatory domain can be derived from, e.g., CD28, OX-40, 4-1BB/CD137 or inducible T cell costimulator (ICOS). The activating domain can be derived from, e.g., CD3, such as CD3 zeta, epsilon, delta, gamma, or the like. In certain embodiments, the CAR is designed to have two, three, four, or more costimulatory domains. The CAR scFv can be designed to target an antigen expressed on a cell associated with a disease or condition, e.g. a tumor antigen, such as, for example, CD19, which is a transmembrane protein expressed by cells in the B cell lineage, including all normal B cells and B cell malignances, including but not limited to NHL, CLL, and non-T cell ALL. Example CAR+ T cell therapies and constructs are described in U.S. Patent Publication Nos. 2013/0287748, 2014/0227237, 2014/0099309, and 2014/0050708, and these references are incorporated by reference in their entirety.

In some aspects, the antigen-binding domain is an antibody or antigen-binding fragment thereof, such as a single chain fragment (scFv). In some embodiments, the antigen is expressed on a tumor or cancer cell. Exemplary of an antigen is CD19. Exemplary of a CAR is an anti-CD19 CAR, such as a CAR containing an anti-CD19 scFv set forth in SEQ ID NO:1152. In some embodiments, the CAR further contains a spacer, a transmembrane domain, and an intracellular signaling domain or region comprising an ITAM signaling domain, such as a CD3zeta signaling domain. In some embodiments, the CAR further includes a costimulatory signaling domain.

In some embodiments, the spacer and transmembrane domain are the hinge and transmembrane domain derived from CD8 such as having an exemplary sequence set forth in SEQ ID NO: 130, 1142, 2032 or a sequence of amino acids that exhibits at least 85%, 86%, 87%, 88%, 89%, 90%, 91%, 92%, 93%, 94%, 95%, 96%, 97%, 98%, 99% or more sequence identity to SEQ ID NO:130, 1142, 2032. In some embodiments, the endodomain comprises at CD3-zeta signaling domain. In some embodiments, the CD3-zeta signaling domain comprises the sequence of amino acids set forth in SEQ ID NO: 131 or a sequence of amino acids that exhibits at least 85%, 86%, 87%, 88%, 89%, 90%, 91%, 92%, 93%, 94%, 95%, 96%, 97%, 98% or 99% or more sequence identity to SEQ ID NO:131 and retains the activity of T cell signaling. In some embodiments, the endodomain of a CAR, can further comprise a costimulatory signaling domain or region to further modulate immunomodulatory responses of the T-cell. In some embodiments, the costimulatory signaling domain is or comprises a costimulatory region, or is derived from a costimulatory region, of CD28, ICOS, 41BB or OX40. In some embodiments, the costimulatory signaling domain is a derived from CD28 or 4-1BB and comprises the sequence of amino acids set forth in any of SEQ ID NOS: 1143-1146 or a sequence of amino acids that exhibits at least 85%, 86%, 87%, 88%, 89%, 90%, 91%, 92%, 93%, 94%, 95%, 96%, 97%, 98% or 99% or more sequence identity to SEQ ID NO:1143-1146 and retains the activity of T cell costimulatory signaling.

In some embodiments, the construct encoding the CAR further encodes a second protein, such as a marker, e.g. detectable protein, separated from the CAR by a self-cleaving peptide sequence. In some embodiments, the self-cleaving peptide sequence is an F2A, T2A, E2A or P2A self-cleaving peptide. Exemplary sequences of a T2A self-cleaving peptide are set for the in any one of SEQ ID NOS: 1147, 1155 or 2039 or a sequence of amino acids that exhibits at least 85%, 86%, 87%, 88%, 89%, 90%, 91%, 92%, 93%, 94%, 95%, 96%, 97%, 98% or 99% or more sequence identity to any of SEQ ID NOS: 1147, 1155 or 2039. In some embodiments, the T2A is encoded by the sequence of nucleotides set forth in SEQ ID NO:1155 or a sequence that exhibits at least 85%, 86%, 87%, 88%, 89%, 90%, 91%, 92%, 93%, 94%, 95%, 96%, 97%, 98% or 99% or more sequence identity to any of SEQ ID NO: 1155. In some embodiments, the marker is a detectable protein, such as a fluorescent protein, e.g. a green fluorescent protein (GFP) or blue fluorescent protein (BFP). Exemplary sequences of a fluorescent protein marker are set forth in SEQ ID NO:1148 or 2038 or a sequence of amino acids that exhibits at least 85%, 86%, 87%, 88%, 89%, 90%, 91%, 92%, 93%, 94%, 95%, 96%, 97%, 98% or 99% or more sequence identity to SEQ ID NO:1148 or 2038.

In some embodiments, the CAR is an anti-CD19 CAR that has the sequence of amino acids set forth in any of SEQ ID NOS: 1138, 1149, 1150, 1151, 2033, 2034, 2036 or 2037 or a sequence of amino acids that exhibits at least 85%, 86%, 87%, 88%, 89%, 90%, 91%, 92%, 93%, 94%, 95%, 96%, 97%, 98% or 99% or more sequence identity to any one of SEQ ID NOS: 1138, 1149, 1150, 1151, 2033, 2034, 2036 or 2037. In some embodiments, the CAR is encoded by a sequence of nucleotides set forth in SEQ ID NO: 1153 or 2035 or a sequence of amino acids that exhibits at least 85%, 86%, 87%, 88%, 89%, 90%, 91%, 92%, 93%, 94%, 95%, 96%, 97%, 98% or 99% or more sequence identity to any one of SEQ ID NO: 1153 or 2035.

In another embodiment, the engineered T-cell possesses a TCR, including a recombinant or engineered TCR. In some embodiments, the TCR can be a native TCR. Those of skill in the art will recognize that generally native mammalian T-cell receptors comprise an alpha and a beta chain (or a gamma and a delta chain) involved in antigen specific recognition and binding. In some embodiments, the TCR is an engineered TCR that is modified. In some embodiments, the TCR of an engineered T-cell specifically binds to a tumor associated or tumor specific antigen presented by an APC.

In some embodiments, the immunomodulatory polypeptides, such as transmembrane immunomodulatory polypeptides or secretable immunomodulatory polypeptides, can be incorporated into engineered cells, such as engineered T cells or engineered APCs, by a variety of strategies such as those employed for recombinant host cells. A variety of methods to introduce a DNA construct into primary T cells are known in the art. In some embodiments, viral transduction or plasmid electroporation are employed. In typical embodiments, the nucleic acid molecule encoding the immunomodulatory protein, or the expression vector, comprises a signal peptide that localizes the expressed transmembrane immunomodulatory proteins to the cellular membrane or for secretion. In some embodiments, a nucleic acid encoding a transmembrane immunomodulatory proteins of the invention is sub-cloned into a viral vector, such as a retroviral vector, which allows expression in the host mammalian cell. The expression vector can be introduced into a mammalian host cell and, under host cell culture conditions, the immunomodulatory protein is expressed on the surface or is secreted.

In an exemplary example, primary T-cells can be purified ex vivo (CD4 cells or CD8 cells or both) and stimulated with an activation protocol consisting of various TCR/CD28 agonists, such as anti-CD3/anti-CD28 coated beads. After a 2 or 3 day activation process, a recombinant expression vector containing an immunomodulatory polypeptide can be stably introduced into the primary T cells through art standard lentiviral or retroviral transduction protocols or plasmid electroporation strategies. Cells can be monitored for immunomodulatory polypeptide expression by, for example, flow cytometry using anti-epitope tag or antibodies that cross-react with native parental molecule and polypeptides comprising variant CD155. T-cells that express the immunomodulatory polypeptide can be enriched through sorting with anti-epitope tag antibodies or enriched for high or low expression depending on the application.

Upon immunomodulatory polypeptide expression the engineered T-cell can be assayed for appropriate function by a variety of means. The engineered CAR or TCR co-expression can be validated to show that this part of the engineered T cell was not significantly impacted by the expression of the immunomodulatory protein. Once validated, standard in vitro cytotoxicity, proliferation, or cytokine assays (e.g., IFN-gamma expression) can be used to assess the function of engineered T-cells. Exemplary standard endpoints are percent lysis of the tumor line, proliferation of the engineered T-cell, or IFN-gamma protein expression in culture supernatants. An engineered construct which results in statistically significant increased lysis of tumor line, increased proliferation of the engineered T-cell, or increased IFN-gamma expression over the control construct can be selected for. Additionally, non-engineered, such as native primary or endogenous T-cells could also be incorporated into the same in vitro assay to measure the ability of the immunomodulatory polypeptide construct expressed on the engineered cells, such as engineered T-cells, to modulate activity, including, in some cases, to activate and generate effector function in bystander, native T-cells. Increased expression of activation markers such as CD69, CD44, or CD62L could be monitored on endogenous T cells, and increased proliferation and/or cytokine production could indicate desired activity of the immunomodulatory protein expressed on the engineered T cells.

In some embodiments, the similar assays can be used to compare the function of engineered T cells containing the CAR or TCR alone to those containing the CAR or TCR and a TIP construct. Typically, these in vitro assays are performed by plating various ratios of the engineered T cell and a "tumor" cell line containing the cognate CAR or TCR antigen together in culture. Standard endpoints are percent lysis of the tumor line, proliferation of the engineered T cell, or IFN-gamma production in culture supernatants. An engineered immunomodulatory protein which resulted in statistically significant increased lysis of tumor line, increased proliferation of the engineered T cell, or increased IFN-gamma production over the same TCR or CAR construct alone can be selected for. Engineered human T cells can be analyzed in immunocompromised mice, like the NSG strain, which lacks mouse T, NK and B cells. Engineered human T cells in which the CAR or TCR binds a target counter-structure on the xenograft and is co-expressed with the TIP affinity modified IgSF domain can be adoptively transferred in vivo at different cell numbers and ratios compared to the xenograft. For example, engraftment of CD19+ leukemia tumor lines containing a luciferase/GFP vector can be monitored through bioluminescence or ex vivo by flow cytometry. In a common embodiment, the xenograft is introduced into the murine model, followed by the engineered T cells several days later. Engineered T cells containing the immunomodulatory protein can be assayed for increased survival, tumor clearance, or expanded engineered T cells numbers relative to engineered T cells containing the CAR or TCR alone. As in the in vitro assay, endogenous, native (i.e., non-engineered) human T cells could be co-adoptively transferred to look for successful epitope spreading in that population, resulting in better survival or tumor clearance.

E. Infectious Agents for Expressing Variant Polypeptides and Immunomodulatory Proteins Also provided are infectious agents that contain nucleic acids encoding any of the variant polypeptides, such as CD155 vIgD polypeptides, including secretable or transmembrane immunomodulatory proteins described herein. In some embodiments, such infectious agents can deliver the nucleic acids encoding the variant immunomodulatory polypeptides described herein, such as CD155 vIgD polypeptides, to a target cell in a subject, e.g., immune cell and/or antigen-presenting cell (APC) or tumor cell in a subject. Also provided are nucleic acids contained in such infectious agents, and/or nucleic acids for generation or modification of such infectious agents, such as vectors and/or plasmids, and compositions containing such infectious agents.

In some embodiments, the infectious agent is a microorganism or a microbe. In some embodiments, the infectious agent is a virus or a bacterium. In some embodiments, the infectious agent is a virus. In some embodiments, the infectious agent is a bacterium. In some embodiments, such infectious agents can deliver nucleic acid sequences encoding any of the variant polypeptides, such as CD155 vIgD polypeptides, including secretable or transmembrane immunomodulatory proteins, described herein. Thus, in some embodiments, the cell in a subject that is infected or contacted by the infectious agents can be rendered to express on the cell surface or secrete, the variant immunomodulatory polypeptides. In some embodiments, the infectious agent can also deliver one or more other therapeutics or nucleic acids encoding other therapeutics to the cell and/or to an environment within the subject. In some embodiments, other therapeutics that can be delivered by the infectious agents include cytokines or other immunomodulatory molecules.

In some embodiments, the infectious agent, e.g., virus or bacteria, contains nucleic acid sequences that encode any of the variant polypeptides, such as CD155 vIgD polypeptides, including secretable or transmembrane immunomodulatory proteins, described herein, and by virtue of contact and/or infection of a cell in the subject, the cell expresses the variant polypeptides, such as CD155 vIgD polypeptides, including secretable or transmembrane immunomodulatory proteins, encoded by the nucleic acid sequences contained in the infectious agent. In some embodiments, the infectious agent can be administered to the subject. In some embodiments, the infectious agent can be contacted with cells from the subject ex vivo.

In some embodiments, the variant polypeptides, such as CD155 vIgD polypeptides, including transmembrane immunomodulatory proteins, expressed by the cell infected by the infectious agent is a transmembrane protein and is surface expressed. In some embodiments, the variant polypeptides, such as CD155 vIgD polypeptides, including secretable immunomodulatory proteins, expressed by the cell infected by the infectious agent is expressed and secreted from the cell. The transmembrane immunomodulatory protein or secreted immunomodulatory protein can be any described herein.

In some embodiments, the cells in the subject that are targeted by the infectious agent include a tumor cell, an immune cell, and/or an antigen-presenting cell (APC). In some embodiments, the infectious agent targets a cell in the tumor microenvironment (TME). In some embodiments, the infectious agent delivers the nucleic acids encoding the variant polypeptides, such as CD155 vIgD polypeptides, including secretable or transmembrane immunomodulatory proteins, to an appropriate cell (for example, an APC, such as a cell that displays a peptide/MHC complex on its cell surface, such as a dendritic cell) or tissue (e.g., lymphoid tissue) that will induce and/or augment the desired effect, e.g., immunomodulation and/or a specific cell-medicated immune response, e.g., CD4 and/or CD8 T cell response, which CD8 T cell response may include a cytotoxic T cell (CTL) response. In some embodiments, the infectious agent targets an APC, such as a dendritic cell (DC). In some embodiments, the nucleic acid molecule delivered by the infectious agents described herein include appropriate nucleic acid sequences necessary for the expression of the operably linked coding sequences encoding the variant immunomodulatory polypeptides, in a particular target cell, e.g., regulatory elements such as promoters.

In some embodiments, the infectious agent that contains nucleic acid sequences encoding the immunomodulatory polypeptides can also contain nucleic acid sequences that encode one or more additional gene products, e.g., cytokines, prodrug converting enzymes, cytotoxins and/or detectable gene products. For example, in some embodiments, the infectious agent is an oncolytic virus and the virus can include nucleic acid sequences encoding additional therapeutic gene products (see, e.g., Kim et al., (2009) Nat Rev Cancer 9:64-71; Garcia-Aragoncillo et al., (2010) Curr Opin Mol Ther 12:403-411; see U.S. Pat. Nos. 7,588,767, 7,588, 771, 7,662,398 and 7,754,221 and U.S. Pat. Publ. Nos. 2007/0202572, 2007/0212727, 2010/0062016, 2009/ 0098529, 2009/0053244, 2009/0155287, 2009/0117034, 2010/0233078, 2009/0162288, 2010/0196325, 2009/ 0136917 and 2011/0064650. In some embodiments, the additional gene product can be a therapeutic gene product that can result in death of the target cell (e.g., tumor cell) or gene products that can augment or boost or regulate an immune response (e.g., cytokine). Exemplary gene products also include among an anticancer agent, an anti-metastatic agent, an antiangiogenic agent, an immunomodulatory molecule, an immune checkpoint inhibitor, an antibody, a cytokine, a growth factor, an antigen, a cytotoxic gene product, a pro-apoptotic gene product, an anti-apoptotic product, a cell matrix degradative gene, genes for tissue regeneration and reprogramming human somatic cells to pluripotency, and other genes described herein or known to one of skill in the art. In some embodiments, the additional gene product is Granulocyte-macrophage colony-stimulating factor (GM-CSF).

1. Viruses

In some embodiments, the infectious agent is a virus. In some embodiments, the infectious agent is an oncolytic virus, or a virus that targets particular cells, e.g., immune cells. In some embodiments, the infectious agent targets a tumor cell and/or cancer cell in the subject. In some embodiments, the infectious agent targets an immune cell or an antigen-presenting cell (APC).

In some embodiments, the infectious agent is an oncolytic virus. Oncolytic viruses are viruses that accumulate in tumor cells and replicate in tumor cells. By virtue of replication in the cells, and optional delivery of nucleic acids encoding variant CD155 polypeptides or immunomodulatory polypeptides described herein, tumor cells are lysed, and the tumor shrinks and can be eliminated. Oncolytic viruses can also have a broad host and cell type range. For example, oncolytic viruses can accumulate in immunoprivileged cells or immunoprivileged tissues, including tumors and/or metastases, and also including wounded tissues and cells, thus allowing the delivery and expression of nucleic acids encoding the variant immunomodulatory polypeptides described herein in a broad range of cell types. Oncolytic viruses can also replicate in a tumor cell specific manner, resulting in tumor cell lysis and efficient tumor regression.

Exemplary oncolytic viruses include adenoviruses, adeno-associated viruses, herpes viruses, Herpes Simplex Virus, vesticular stomatic virus, Reovirus, Newcastle Disease virus, parvovirus, measles virus, vesticular stomatitis virus (VSV), Coxsackie virus and Vaccinia virus. In some embodiments, oncolytic viruses can specifically colonize solid tumors, while not infecting other organs, and can be used as an infectious agent to deliver the nucleic acids encoding the variant immunomodulatory polypeptides described herein to such solid tumors.

Oncolytic viruses for use in delivering the nucleic acids encoding variant CD155 polypeptides or immunomodulatory polypeptides described herein, can be any of those known to one of skill in the art and include, for example, vesicular stomatitis virus, see, e.g., U.S. Pat. Nos. 7,731,974, 7,153,510, 6,653,103 and U.S. Pat. Pub. Nos. 2010/ 0178684, 2010/0172877, 2010/0113567, 2007/0098743, 20050260601, 20050220818 and EP Pat. Nos. 1385466, 1606411 and 1520175; herpes simplex virus, see, e.g., U.S. Pat. Nos. 7,897,146, 7,731,952, 7,550,296, 7,537,924, 6,723,316, 6,428,968 and U.S. Pat. Pub. Nos., 2014/ 0154216, 2011/0177032, 2011/0158948, 2010/0092515, 2009/0274728, 2009/0285860, 2009/0215147, 2009/ 0010889, 2007/0110720, 2006/0039894, 2004/0009604, 2004/0063094, International Patent Pub. Nos., WO 2007/ 052029, WO 1999/038955; retroviruses, see, e.g., U.S. Pat. Nos. 6,689,871, 6,635,472, 5,851,529, 5,716,826, 5,716,613 and U.S. Pat. Pub. No. 20110212530; vaccinia viruses, see, e.g., 2016/0339066, and adeno-associated viruses, see, e.g., U.S. Pat. Nos. 8,007,780, 7,968,340, 7,943,374, 7,906,111, 7,927,585, 7,811,814, 7,662,627, 7,241,447, 7,238,526, 7,172,893, 7,033,826, 7,001,765, 6,897,045, and 6,632,670.

Oncolytic viruses also include viruses that have been genetically altered to attenuate their virulence, to improve their safety profile, enhance their tumor specificity, and they have also been equipped with additional genes, for example cytotoxins, cytokines, prodrug converting enzymes to improve the overall efficacy of the viruses (see, e.g., Kirn et al., (2009) Nat Rev Cancer 9:64-71; Garcia-Aragoncillo et al., (2010) Curr Opin Mol Ther 12:403-411; see U.S. Pat. Nos. 7,588,767, 7,588,771, 7,662,398 and 7,754,221 and U.S. Pat. Publ. Nos. 2007/0202572, 2007/0212727, 2010/ 0062016, 2009/0098529, 2009/0053244, 2009/0155287, 2009/0117034, 2010/0233078, 2009/0162288, 2010/ 0196325, 2009/0136917 and 2011/0064650). In some embodiments, the oncolytic viruses can be those that have been modified so that they selectively replicate in cancerous cells, and, thus, are oncolytic. For example, the oncolytic virus is an adenovirus that has been engineered to have modified tropism for tumor therapy and also as gene therapy vectors. Exemplary of such is ONYX-015, H101 and Ad5ΔCR (Hallden and Portella (2012) Expert Opin Ther Targets, 16:945-58) and TNFerade (McLoughlin et al.

(2005) Ann. Surg. Oncol., 12:825-30), or a conditionally replicative adenovirus Oncorine®.

In some embodiments, the infectious agent is a modified herpes simplex virus. In some embodiments, the infectious agent is a modified version of Talimogene laherparepvec (also known as T-Vec, Imlygic or OncoVex GM-CSF), that is modified to contain nucleic acids encoding any of the variant immunomodulatory polypeptides described herein, such as variant CD155 polypeptide described herein. In some embodiments, the infectious agent is a modified herpes simplex virus that is described, e.g., in WO 2007/052029, WO 1999/038955, US 2004/0063094, US 2014/0154216, or, variants thereof.

In some embodiments, the infectious agent is a virus that targets a particular type of cells in a subject that is administered the virus, e.g., a virus that targets immune cells or antigen-presenting cells (APCs). Dendritic cells (DCs) are essential APCs for the initiation and control of immune responses. DCs can capture and process antigens, migrate from the periphery to a lymphoid organ, and present the antigens to resting T cells in a major histocompatibility complex (MHC)-restricted fashion. In some embodiments, the infectious agent is a virus that specifically can target DCs to deliver nucleic acids encoding the variant CD155 polypeptide or immunomodulatory polypeptides for expression in DCs. In some embodiments, the virus is a lentivirus or a variant or derivative thereof, such as an integration-deficient lentiviral vector. In some embodiments, the virus is a lentivirus that is pseudotyped to efficiently bind to and productively infect cells expressing the cell surface marker dendritic cell-specific intercellular adhesion molecule-3-grabbing non-integrin (DC-SIGN), such as DCs. In some embodiments, the virus is a lentivirus pseudotyped with a Sindbis virus E2 glycoprotein or modified form thereof, such as those described in WO 2013/149167. In some embodiments, the virus allows for delivery and expression of a sequence of interest (e.g., a nucleic acid encoding any of the variant CD155 polypeptide or immunomodulatory polypeptides described herein) to a DC. In some embodiments, the virus includes those described in WO 2008/011636 or US 2011/0064763, Tareen et al. (2014) Mol. Ther., 22:575-587, or variants thereof. Exemplary of a dendritic cell-tropic vector platform is ZVex™.

2. Bacteria

In some embodiments, the infectious agent is a bacterium. For example, in some embodiments, the bacteria can deliver nucleic acids encoding any of the variant CD155 polypeptide or immunomodulatory polypeptides described herein to a target cell in the subject, such as a tumor cell, an immune cell, an antigen-presenting cell and/or a phagocytic cell. In some embodiments, the bacterium can be preferentially targeted to a specific environment within a subject, such as a tumor microenvironment (TME), for expression and/or secretion of the variant immunomodulatory polypeptides and/or to target specific cells in the environment for expression of the variant immunomodulatory polypeptides.

In some embodiments, the bacterium delivers the nucleic acids to the cells via bacterial-mediated transfer of plasmid DNA to mammalian cells (also referred to as "bactofection"). For example, in some embodiments, delivery of genetic material is achieved through entry of the entire bacterium into target cells. In some embodiments, spontaneous or induced bacterial lysis can lead to the release of plasmid for subsequent eukaryotic cell expression. In some embodiments, the bacterium can deliver nucleic acids to non-phagocytic mammalian cells (e.g., tumor cells) and/or to phagocytic cells, e.g., certain immune cells and/or APCs.

In some embodiments, the nucleic acids delivered by the bacterium can be transferred to the nucleus of the cell in the subject for expression. In some embodiments, the nucleic acids also include appropriate nucleic acid sequences necessary for the expression of the operably linked sequences encoding the variant immunomodulatory polypeptides in a particular host cell, e.g., regulatory elements such as promoters or enhancers. In some embodiments, the infectious agent that is a bacterium can deliver nucleic acids encoding the immunomodulatory proteins in the form of an RNA, such as a pre-made translation-competent RNA delivered to the cytoplasm of the target cell for translation by the target cell's machinery.

In some embodiments, the bacterium can replicate and lyse the target cells, e.g., tumor cells. In some embodiments, the bacterium can contain and/or release nucleic acid sequences and/or gene products in the cytoplasm of the target cells, thereby killing the target cell, e.g., tumor cell. In some embodiments, the infectious agent is bacterium that can replicate specifically in a particular environment in the subject, e.g., tumor microenvironment (TME). For example, in some embodiments, the bacterium can replicate specifically in anaerobic or hypoxic microenvironments. In some embodiments, conditions or factors present in particular environments, e.g., aspartate, serine, citrate, ribose or galactose produced by cells in the TME, can act as chemoattractants to attract the bacterium to the environment. In some embodiments, the bacterium can express and/or secrete the immunomodulatory proteins described herein in the environment, e.g., TME.

In some embodiments, the infectious agent is a bacterium that is a *Listeria* sp., a *Bifidobacterium* sp., an *Escherichia* sp., a *Clostridium* sp., a *Salmonella* sp., a *Shigella* sp., a *Vibrio* sp. or a *Yersinia* sp. In some embodiments, the bacterium is selected from among one or more of *Listeria monocytogenes*, *Salmonella typhimurium*, *Salmonella choleraesuis*, *Escherichia coli*, *Vibrio cholera*, *Clostridium perfringens*, *Clostridium butyricum*, *Clostridium novyi*, *Clostridium acetobutylicum*, *Bifidobacterium infantis*, *Bifidobacterium longum* and *Bifidobacterium adolescentis*. In some embodiments, the bacterium is an engineered bacterium. In some embodiments, the bacterium is an engineered bacterium such as those described in, e.g., Seow and Wood (2009) Molecular Therapy 17(5):767-777; Baban et al. (2010) Bioengineered Bugs 1:6, 385-394; Patyar et al. (2010) J Biomed Sci 17:21; Tangney et al. (2010) Bioengineered Bugs 1:4, 284-287; van Pijkeren et al. (2010) Hum Gene Ther. 21(4):405-416; WO 2012/149364; WO 2014/198002; U.S. Pat. Nos. 9,103,831; 9,453,227; US 2014/0186401; US 2004/0146488; US 2011/0293705; US 2015/0359909 and EP 3020816. The bacterium can be modified to deliver nucleic acid sequences encoding any of the variant immunomodulatory polypeptides, conjugates and/or fusions provided herein, and/or to express such variant immunomodulatory polypeptides in the subject.

F. Nucleic Acids, Vectors and Methods for Producing the Polypeptides or Cells

Provided herein are isolated or recombinant nucleic acids collectively referred to as "nucleic acids" which encode any of the various provided embodiments of the variant CD155 polypeptides or immunomodulatory polypeptides provided herein. In some embodiments, nucleic acids provided herein, including all described below, are useful in recombinant production (e.g., expression) of variant CD155 polypeptides or immunomodulatory polypeptides provided herein. In some embodiments, nucleic acids provided herein, including all described below, are useful in expression of variant CD155 polypeptides or immunomodulatory polypeptides provided herein in cells, such as in engineered cells, e.g. immune cells, or infectious agent cells. The nucleic acids provided herein can be in the form of RNA or in the form of DNA, and include mRNA, cRNA, recombinant or synthetic RNA and DNA, and cDNA. The nucleic acids provided herein are typically DNA molecules, and usually double-stranded DNA molecules. However, single-stranded DNA, single-stranded RNA, double-stranded RNA, and hybrid DNA/RNA nucleic acids or combinations thereof comprising any of the nucleotide sequences of the invention also are provided.

Also provided herein are recombinant expression vectors and recombinant host cells useful in producing the variant CD155 polypeptides or immunomodulatory polypeptides provided herein.

Also provided herein are engineered cells, such as engineered immune cells, containing any of the provided nucleic acids or encoded variant CD155 polypeptides or immunomodulatory polypeptides, such as any of the transmembrane immunomodulatory polypeptides or secretable immunomodulatory polypeptides.

Also provided herein are infectious agents, such as bacterial or viral cells, containing any of the provided nucleic acids or encoded variant CD155 polypeptides or immunomodulatory polypeptides, such as any of the transmembrane immunomodulatory polypeptides or secretable immunomodulatory polypeptides.

In any of the above provided embodiments, the nucleic acids encoding the immunomodulatory polypeptides provided herein can be introduced into cells using recombinant DNA and cloning techniques. To do so, a recombinant DNA molecule encoding an immunomodulatory polypeptide is prepared. Methods of preparing such DNA molecules are well known in the art. For instance, sequences coding for the peptides could be excised from DNA using suitable restriction enzymes. Alternatively, the DNA molecule could be synthesized using chemical synthesis techniques, such as the phosphoramidite method. Also, a combination of these techniques could be used. In some instances, a recombinant or synthetic nucleic acid may be generated through polymerase chain reaction (PCR). In some embodiments, a DNA insert can be generated encoding one or more variant CD155 polypeptides containing at least one affinity-modified IgSF domain and, in some embodiments, a signal peptide, a transmembrane domain and/or an endodomain in accord with the provided description. This DNA insert can be cloned into an appropriate transduction/transfection vector as is known to those of skill in the art. Also provided are expression vectors containing the nucleic acid molecules.

In some embodiments, the expression vectors are capable of expressing the immunomodulatory proteins in an appropriate cell under conditions suited to expression of the protein. In some aspects, nucleic acid molecule or an expression vector comprises the DNA molecule that encodes the immunomodulatory protein operatively linked to appropriate expression control sequences. Methods of effecting this operative linking, either before or after the DNA molecule is inserted into the vector, are well known. Expression control sequences include promoters, activators, enhancers, operators, ribosomal binding sites, start signals, stop signals, cap signals, polyadenylation signals, and other signals involved with the control of transcription or translation.

In some embodiments, expression of the immunomodulatory protein is controlled by a promoter or enhancer to control or regulate expression. The promoter is operably linked to the portion of the nucleic acid molecule encoding the variant polypeptide or immunomodulatory protein. In some embodiments, the promotor is a constitutively active promotor (such as a tissue-specific constitutively active promotor or other constitutive promotor). In some embodiments, the promotor is an inducible promotor, which may be responsive to an inducing agent (such as a T cell activation signal).

In some embodiments, a constitutive promoter is operatively linked to the nucleic acid molecule encoding the variant polypeptide or immunomodulatory protein. Exemplary constitutive promoters include the Simian vacuolating virus 40 (SV40) promoter, the cytomegalovirus (CMV) promoter, the ubiquitin C (UbC) promoter, and the EF-1 alpha (EF1a) promoter. In some embodiments, the constitutive promoter is tissue specific. For example, in some embodiments, the promoter allows for constitutive expression of the immunomodulatory protein in specific tissues, such as immune cells, lymphocytes, or T cells. Exemplary tissue-specific promoters are described in U.S. Pat. No. 5,998,205, including, for example, a fetoprotein, DF3, tyrosinase, CEA, surfactant protein, and ErbB2 promoters.

In some embodiments, an inducible promoter is operatively linked to the nucleic acid molecule encoding the variant polypeptide or immunomodulatory protein such that expression of the nucleic acid is controllable by controlling the presence or absence of the appropriate inducer of transcription. For example, the promoter can be a regulated promoter and transcription factor expression system, such as the published tetracycline-regulated systems or other regulatable systems (see, e.g. published International PCT Appl. No. WO 01/30843), to allow regulated expression of the encoded polypeptide. An exemplary regulatable promoter system is the Tet-On (and Tet-Off) system available, for example, from Clontech (Palo Alto, CA). This promoter system allows the regulated expression of the transgene controlled by tetracycline or tetracycline derivatives, such as doxycycline. Other regulatable promoter systems are known (see e.g., published U.S. Application No. 2002-0168714, entitled "Regulation of Gene Expression Using Single-Chain, Monomeric, Ligand Dependent Polypeptide Switches," which describes gene switches that contain ligand binding domains and transcriptional regulating domains, such as those from hormone receptors).

In some embodiments, the promotor is responsive to an element responsive to T-cell activation signaling. Solely by way of example, in some embodiments, an engineered T cell comprises an expression vector encoding the immunomodulatory protein and a promotor operatively linked to control expression of the immunomodulatory protein. The engineered T cell can be activated, for example by signaling through an engineered T cell receptor (TCR) or a chimeric antigen rector (CAR), and thereby triggering expression and secretion of the immunomodulatory protein through the responsive promotor.

In some embodiments, an inducible promoter is operatively linked to the nucleic acid molecule encoding the immunomodulatory protein such that the immunomodulatory protein is expressed in response to a nuclear factor of activated T-cells (NFAT) or nuclear factor kappa-light-chain enhancer of activated B cells (NF-κB). For example, in some embodiments, the inducible promoter comprises a binding site for NFAT or NF-κB. For example, in some embodiments, the promoter is an NFAT or NF-κB promoter or a functional variant thereof. Thus, in some embodiments, the nucleic acids make it possible to control the expression of immunomodulatory protein while also reducing or eliminating the toxicity of the immunomodulatory protein. In particular, engineered immune cells comprising the nucleic acids of the invention express and secrete the immunomodulatory protein only when the cell (e.g., a T-cell receptor (TCR) or a chimeric antigen receptor (CAR) expressed by the cell) is specifically stimulated by an antigen and/or the cell (e.g., the calcium signaling pathway of the cell) is non-specifically stimulated by, e.g., phorbol myristate acetate (PMA)/Ionomycin. Accordingly, the expression and, in some cases, secretion, of immunomodulatory protein can be controlled to occur only when and where it is needed (e.g., in the presence of an infectious disease-causing agent, cancer, or at a tumor site), which can decrease or avoid undesired immunomodulatory protein interactions.

In some embodiments, the nucleic acid encoding an immunomodulatory protein described herein comprises a suitable nucleotide sequence that encodes a NFAT promoter, NF-κB promoter, or a functional variant thereof. "NFAT promoter" as used herein means one or more NFAT responsive elements linked to a minimal promoter. "NF-κB promoter" refers to one or more NF-κB responsive elements linked to a minimal promoter. In some embodiments, the minimal promoter of a gene is a minimal human IL-2 promoter or a CMV promoter. The NFAT responsive elements may comprise, e.g., NFAT1, NFAT2, NFAT3, and/or NFAT4 responsive elements. The NFAT promoter, NF-κB promoter, or a functional variant thereof may comprise any number of binding motifs, e.g., at least two, at least three, at least four, at least five, or at least six, at least seven, at least eight, at least nine, at least ten, at least eleven, or up to twelve binding motifs.

The resulting recombinant expression vector having the DNA molecule thereon is used to transform an appropriate host. This transformation can be performed using methods well known in the art. In some embodiments, a nucleic acid provided herein further comprises nucleotide sequence that encodes a secretory or signal peptide operably linked to the nucleic acid encoding an immunomodulatory polypeptide such that a resultant soluble immunomodulatory polypeptide is recovered from the culture medium, host cell, or host cell periplasm. In other embodiments, the appropriate expression control signals are chosen to allow for membrane expression of an immunomodulatory polypeptide. Furthermore, commercially available kits as well as contract manufacturing companies can also be utilized to make engineered cells or recombinant host cells provided herein.

In some embodiments, the resulting expression vector having the DNA molecule thereon is used to transform, such as transduce, an appropriate cell. The introduction can be performed using methods well known in the art. Exemplary methods include those for transfer of nucleic acids encoding the receptors, including via viral, e.g., retroviral or lentiviral, transduction, transposons, and electroporation. In some embodiments, the expression vector is a viral vector. In some embodiments, the nucleic acid is transferred into cells by lentiviral or retroviral transduction methods.

Any of a large number of publicly available and well-known mammalian host cells, including mammalian T-cells or APCs, can be used in the preparing the polypeptides or engineered cells. The selection of a cell is dependent upon a number of factors recognized by the art. These include, for example, compatibility with the chosen expression vector, toxicity of the peptides encoded by the DNA molecule, rate of transformation, ease of recovery of the peptides, expression characteristics, bio-safety and costs. A balance of these factors must be struck with the understanding that not all cells can be equally effective for the expression of a particular DNA sequence.

In some embodiments, the host cells can be a variety of eukaryotic cells, such as in yeast cells, or with mammalian cells such as Chinese hamster ovary (CHO) or HEK293 cells. In some embodiments, the host cell is a suspension cell and the polypeptide is engineered or produced in cultured suspension, such as in cultured suspension CHO cells, e.g. CHO-S cells. In some examples, the cell line is a CHO cell line that is deficient in DHFR (DHFR-), such as DG44 and DUXB11. In some embodiments, the cell is deficient in glutamine synthase (GS), e.g. CHO-S cells, CHOK1 SV cells, and CHOZN((R)) GS–/– cells. In some embodiments, the CHO cells, such as suspension CHO cells, may be CHO-S-2H2 cells, CHO-S-clone 14 cells, or ExpiCHO-S cells.

In some embodiments, host cells can also be prokaryotic cells, such as with *E. coli*.

The transformed recombinant host is cultured under polypeptide expressing conditions, and then purified to obtain a soluble protein. Recombinant host cells can be cultured under conventional fermentation conditions so that the desired polypeptides are expressed. Such fermentation conditions are well known in the art. Finally, the polypeptides provided herein can be recovered and purified from recombinant cell cultures by any of a number of methods well known in the art, including ammonium sulfate or ethanol precipitation, acid extraction, anion or cation exchange chromatography, phosphocellulose chromatography, hydrophobic interaction chromatography, and affinity chromatography. Protein refolding steps can be used, as desired, in completing configuration of the mature protein. Finally, high performance liquid chromatography (HPLC) can be employed in the final purification steps.

In some embodiments, the cell is an immune cell, such as any described above in connection with preparing engineered cells. In some embodiments, such engineered cells are primary cells. In some embodiments, the engineered cells are autologous to the subject. In some embodiment, the engineered cells are allogeneic to the subject. In some embodiments, the engineered cells are obtained from a subject, such as by leukapheresis, and transformed ex vivo for expression of the immunomodulatory polypeptide, e.g. transmembrane immunomodulatory polypeptide or secretable immunomodulatory polypeptide.

Also provided are nucleic acids encoding any of the variant immunomodulatory polypeptides contained in infectious agents described herein. In some embodiments, the infectious agents deliver the nucleic acids to a cell in the subject, and/or permit expression of the encoded variant polypeptides in the cell. Also provided are nucleic acids that are used to generate, produce or modify such infectious agents. For example, in some embodiments, provided are vectors and/or plasmids that contain nucleic acids encoding the variant immunomodulatory polypeptides, for generation of the infectious agents, delivery to the cells in a subject and/or expression of the variant immunomodulatory polypeptides in the cells in the subject.

In some embodiments, the provided nucleic acids are recombinant viral or bacterial vectors containing nucleic acid sequences encoding the variant immunomodulatory polypeptides. In some embodiments, the recombinant vectors can be used to produce an infectious agent that contains nucleic acid sequences encoding the variant immunomodulatory polypeptides and/or to be delivered to a target cell in the subject for expression by the target cell. In some embodiments, the recombinant vector is an expression vector. In some embodiments, the recombinant vector includes appropriate sequences necessary for generation and/or production of the infectious agent and expression in the target cell.

In some embodiments, the recombinant vector is a plasmid or cosmid. Plasmid or cosmid containing nucleic acid sequences encoding the variant immunomodulatory polypeptides, as described herein, is readily constructed using standard techniques well known in the art. For generation of the infectious agent, the vector or genome can be constructed in a plasmid form that can then be transfected into a packaging or producer cell line or a host bacterium. The recombinant vectors can be generated using any of the recombinant techniques known in the art. In some embodiments, the vectors can include a prokaryotic origin of replication and/or a gene whose expression confers a detectable or selectable marker such as a drug resistance for propagation and/or selection in prokaryotic systems.

In some embodiments, the recombinant vector is a viral vector. Exemplary recombinant viral vectors include a lentiviral vector genome, poxvirus vector genome, vaccinia virus vector genome, adenovirus vector genome, adenovirus-associated virus vector genome, herpes virus vector genome, and alpha virus vector genome. Viral vectors can be live, attenuated, replication conditional or replication deficient, non-pathogenic (defective), replication competent viral vector, and/or is modified to express a heterologous gene product, e.g., the variant immunomodulatory polypeptides provided herein. Vectors for generation of viruses also can be modified to alter attenuation of the virus, which includes any method of increasing or decreasing the transcriptional or translational load.

Exemplary viral vectors that can be used include modified vaccinia virus vectors (see, e.g., Guerra et al., J. Virol. 80:985-98 (2006); Tartaglia et al., AIDS Research and Human Retroviruses 8: 1445-47 (1992); Gheradi et al., J. Gen. Virol. 86:2925-36 (2005); Mayr et al., Infection 3:6-14 (1975); Hu et al., J. Virol. 75: 10300-308 (2001); U.S. Pat. Nos. 5,698,530, 6,998,252, 5,443,964, 7,247,615 and 7,368, 116); adenovirus vector or adenovirus-associated virus vectors (see., e.g., Molin et al., J. Virol. 72:8358-61 (1998); Narumi et al., Am J. Respir. Cell Mol. Biol. 19:936-41 (1998); Mercier et al., Proc. Natl. Acad. Sci. USA 101:6188-93 (2004); U.S. Pat. Nos. 6,143,290; 6,596,535; 6,855,317; 6,936,257; 7,125,717; 7,378,087; 7,550,296); retroviral vectors including those based upon murine leukemia virus (MuLV), gibbon ape leukemia virus (GaLV), ecotropic retroviruses, simian immunodeficiency virus (SIV), human immunodeficiency virus (HIV), and combinations (see, e.g., Buchscher et al., J. Virol. 66:2731-39 (1992); Johann et al., J. Virol. 66: 1635-40 (1992); Sommerfelt et al., Virology 176:58-59 (1990); Wilson et al., J. Virol. 63:2374-78 (1989); Miller et al., J. Virol. 65:2220-24 (1991); Miller et al., Mol. Cell Biol. 10:4239 (1990); Kolberg, NIH Res. 4:43 1992; Cornetta et al., Hum. Gene Ther. 2:215 (1991)); lentiviral vectors including those based upon Human Immunodeficiency Virus (HIV-1), HIV-2, feline immunodeficiency virus (FIV), equine infectious anemia virus, Simian Immunodeficiency Virus (SIV), and maedi/visna virus (see, e.g., Pfeifer et al., Annu. Rev. Genomics Hum. Genet. 2: 177-211 (2001); Zufferey et al., J. Virol. 72: 9873, 1998; Miyoshi et al., J. Virol. 72:8150, 1998; Philpott and Thrasher, Human Gene Therapy 18:483, 2007; Engelman et al., J. Virol. 69: 2729, 1995; Nightingale et al., Mol. Therapy, 13: 1121, 2006; Brown et al., J. Virol. 73:9011 (1999); WO 2009/076524; WO 2012/141984; WO 2016/011083; McWilliams et al., J. Virol. 77: 11150, 2003; Powell et al., J. Virol. 70:5288, 1996) or any, variants thereof, and/or vectors that can be used to generate any of the viruses described above. In some embodiments, the recombinant vector can include regulatory sequences, such as promoter or enhancer sequences, that can regulate the expression of the viral genome, such as in the case for RNA viruses, in the packaging cell line (see, e.g., U.S. Pat. Nos. 5,385,839 and 5,168,062).

In some embodiments, the recombinant vector is an expression vector, e.g., an expression vector that permits expression of the encoded gene product when delivered into the target cell, e.g., a cell in the subject, e.g., a tumor cell, an immune cell and/or an APC. In some embodiments, the recombinant expression vectors contained in the infectious agent are capable of expressing the immunomodulatory proteins in the target cell in the subject, under conditions suited to expression of the protein.

In some aspects, nucleic acids or an expression vector comprises a nucleic acid sequence that encodes the immunomodulatory protein operatively linked to appropriate expression control sequences. Methods of affecting this operative linking, either before or after the nucleic acid sequence encoding the immunomodulatory protein is inserted into the vector, are well known. Expression control sequences include promoters, activators, enhancers, operators, ribosomal binding sites, start signals, stop signals, cap signals, polyadenylation signals, and other signals involved with the control of transcription or translation. The promoter can be operably linked to the portion of the nucleic acid sequence encoding the immunomodulatory protein. In some embodiments, the promotor is a constitutively active promotor in the target cell (such as a tissue-specific constitutively active promotor or other constitutive promotor). For example, the recombinant expression vector may also include, lymphoid tissue-specific transcriptional regulatory elements (TRE) such as a B lymphocyte, T lymphocyte, or dendritic cell specific TRE. Lymphoid tissue specific TRE are known in the art (see, e.g., Thompson et al., Mol. Cell. Biol. 12:1043-53 (1992); Todd et al., J. Exp. Med. 177: 1663-74 (1993); Penix et al., J. Exp. Med. 178:1483-96 (1993)). In some embodiments, the promotor is an inducible promotor, which may be responsive to an inducing agent (such as a T cell activation signal). In some embodiments, nucleic acids delivered to the target cell in the subject, e.g., tumor cell, immune cell and/or APC, can be operably linked to any of the regulatory elements described above.

In some embodiments, the vector is a bacterial vector, e.g., a bacterial plasmid or cosmid. In some embodiments, the bacterial vector is delivered to the target cell, e.g., tumor cells, immune cells and/or APCs, via bacterial-mediated transfer of plasmid DNA to mammalian cells (also referred to as "bactofection"). In some embodiments, the delivered bacterial vector also contains appropriate expression control sequences for expression in the target cells, such as a promoter sequence and/or enhancer sequences, or any regulatory or control sequences described above. In some embodiments, the bacterial vector contains appropriate expression control sequences for expression and/or secretion of the encoded variant polypeptides in the infectious agent, e.g., the bacterium.

In some embodiments, polypeptides provided herein can also be made by synthetic methods. Solid phase synthesis is the preferred technique of making individual peptides since it is the most cost-effective method of making small peptides. For example, well known solid phase synthesis techniques include the use of protecting groups, linkers, and solid phase supports, as well as specific protection and deprotection reaction conditions, linker cleavage conditions, use of scavengers, and other aspects of solid phase peptide synthesis. Peptides can then be assembled into the polypeptides as provided herein.

IV. Methods of Assessing Activity Immune Modulation of Variant CD155 Polypeptides and Immunomodulatory Proteins In some embodiments, the variant CD155 polypeptides provided herein (e.g. full-length and/or specific binding fragments or conjugates, stack constructs or fusion thereof or engineered cells) exhibit immunomodulatory activity to modulate T cell activation. In some embodiments, CD155 polypeptides modulate IFN-gamma expression in a T cell assay relative to a wild-type or unmodified CD155 control. In some cases, modulation of IFN-gamma expression can increase or decrease IFN-gamma expression relative to the control. Assays to determine specific binding and IFN-gamma expression are well-known in the art and include the MLR (mixed lymphocyte reaction) assays measuring interferon-gamma cytokine levels in culture supernatants (Wang et al., Cancer Immunol Res. 2014 September: 2(9):846-56), SEB (staphylococcal enterotoxin B) T cell stimulation assay (Wang et al., Cancer Immunol Res. 2014 September: 2(9): 846-56), and anti-CD3 T cell stimulation assays (Li and Kurlander, J Transl Med. 2010: 8: 104).

In some embodiments, a variant CD155 polypeptide can in some embodiments increase or, in alternative embodiments, decrease IFN-gamma (interferon-gamma) expression in a primary T-cell assay relative to a wild-type CD155 control. In some embodiments, such activity may depend on whether the variant CD155 polypeptide is provided in a form for antagonist activity or in a form for agonist activity. In some embodiments, a variant CD155 polypeptide or immunomodulatory protein is an antagonist of the inhibitory receptor, such as blocks an inhibitory signal in the cell that may occur to decrease response to activating stimuli, e.g., CD3 and/or CD28 costimulatory signal or a mitogenic signal. Those of skill will recognize that different formats of the primary T-cell assay used to determine an increase or decrease in IFN-gamma expression exist.

In assaying for the ability of a variant CD155 to increase or decrease IFN-gamma expression in a primary T-cell assay, a Mixed Lymphocyte Reaction (MLR) assay can be used. In some cases, a soluble form of a variant CD155 that preferentially or specifically binds CD226 can be employed to determine the ability of the variant CD155 to antagonize T cells and thereby decrease the IFN-gamma expression in a MLR.

Alternatively, in some embodiments, a variant CD155 polypeptide or immunomodulatory protein provided in antagonist form, such as soluble form, e.g. variant CD155-Fc or secretable immunomodulatory protein, block activity of the TIGIT inhibitory receptor and thereby increase MLR activity in the assay, such as observed by increased production of IFN-gamma in the assay. Thus, in some embodiments, soluble form of a variant CD155 which preferentially binds TIGIT can be employed to determine the ability of the variant CD155 to block inhibitory signal in T cells and thereby increase the IFN-gamma expression in a MLR.

In some embodiments, a variant CD155 polypeptide or immunomodulatory protein provided in agonist form, such as a localizing vIgD stack or conjugate containing a tumor-localizing moiety or an engineered cell expressing a trans-membrane immunomodulatory protein as provided, may stimulate activity of the TIGIT inhibitory receptor and thereby decrease MLR activity, such as evidenced by decreased IFN-gamma production. In some embodiments, a variant CD155 polypeptide or immunomodulatory protein provided in agonist form, such as a localizing vIgD stack or conjugate containing a tumor-localizing moiety or an engineered cell expressing a transmembrane immunomodulatory protein as provided, may block activity of the TIGIT inhibitory receptor and thereby increase MLR activity, such as increase IFN-gamma production.

Alternatively, in assaying for the ability of a variant CD155 to modulate an increase or decrease IFN-gamma expression in a primary T-cell assay, a co-immobilization assay can be used. In a co-immobilization assay, a TCR signal, provided in some embodiments by anti-CD3 antibody, is used in conjunction with a co-immobilized variant CD155 to determine the ability to increase or decrease IFN-gamma expression relative to a CD155 unmodified or wild-type control. In some embodiments, a variant CD155 polypeptide or immunomodulatory protein, e.g. a co-immobilized variant CD155 (e.g., CD155-Fc), decreases IFN-gamma production in a co-immobilization assay.

In some embodiments, in assaying for the ability of a variant CD155 to modulate an increase or decrease IFN-gamma expression a T cell reporter assay can be used. In some embodiments, the T cell is a Jurkat T cell line or is derived from Jurkat T cell lines. In reporter assays, the reporter cell line (e.g. Jurkat reporter cell) also is generated to overexpress an inhibitory receptor that is the cognate binding partner of the variant IgSF domain polypeptide. For example, in the case of a variant CD155, the reporter cell line (e.g. Jurkat reporter cell) is generated to overexpress TIGIT. In some embodiments, the reporter T cells also contain a reporter construct containing an inducible promoter responsive to T cell activation operably linked to a reporter. In some embodiments, the reporter is a fluorescent or luminescent reporter. In some embodiments, the reporter is luciferase. In some embodiments, the promoter is responsive to CD3 signaling. In some embodiments, the promoter is an NFAT promoter. In some embodiments, the promoter is responsive to costimulatory signaling, e.g. CD28 costimulatory signaling. In some embodiments, the promoter is an IL-2 promoter.

In aspects of a reporter assay, a reporter cell line is stimulated, such as by co-incubation with antigen presenting cells (APCs) expressing the wild-type ligand of the inhibitory receptor, e.g. CD155. In some embodiments, the APCs are artificial APCs. Artificial APCs are well known to a skilled artisan. In some embodiments, artificial APCs are derived from one or more mammalian cell line, such as K562, CHO or 293 cells.

In some embodiments, the Jurkat reporter cells are co-incubated with artificial APCs overexpressing the inhibitory ligand in the presence of the variant IgSF domain molecule or immunomodulatory protein, e.g., variant CD155 polypeptide or immunomodulatory protein. In some embodiments, reporter expression is monitored, such as by determining the luminescence or fluorescence of the cells. In some embodiments, normal interactions between its inhibitory receptor and ligand result in a repression of or decrease in the reporter signal, such as compared to control, e.g. reporter expression by co-incubation of control T cells and APCs in which the inhibitory receptor and ligand interaction is not present, e.g. APCs that do not overexpress CD155. In some embodiments, a variant CD155 polypeptide or immunomodulatory protein provided herein antagonizes the interaction, e.g. when provided in soluble form as a variant CD155-Fc or when expressed from the APC as a secretable immunomodulatory protein, thereby resulting in an increase in the reporter signal compared to the absence of the variant CD155 polypeptide or immunomodulatory protein. In some cases, certain formats of a variant CD155 polypeptide or immunomodulatory protein as provided herein may provide an agonist activity, thereby decreasing reporter expression compared to the absence of the variant CD155 polypeptide or immunomodulatory protein., Use of proper controls is known to those of skill in the art, however, in the afore-mentioned embodiments, a control typically involves use of the unmodified CD155, such as a wild-type of native CD155 isoform from the same mammalian species from which the variant CD155 was derived or developed. In some embodi-ments, the wild-type or native CD155 is of the same form or corresponding form as the variant. For example, if the variant CD155 is a soluble form containing a variant ECD fused to an Fc protein, then the control is a soluble form containing the wild-type or native ECD of CD155 fused to the Fc protein. Irrespective of whether the binding affinity and/or selectivity to TIGIT is increased or decreased, a variant CD155 in some embodiments will increase IFN-gamma expression and, in alternative embodiments, decrease IFN-gamma expression in a T-cell assay relative to a wild-type CD155 control.

In some embodiments, a variant CD155 polypeptide or immunomodulatory protein, increases IFN-gamma expres-sion (i.e., protein expression) relative to a wild-type or unmodified CD155 control by at least: 5%, 10%, 20%, 30%, 40%, 50%, 60%, 70%, 80%, 90%, or higher. In other embodiments, a variant CD155 or immunomodulatory pro-tein decreases IFN-gamma expression (i.e. protein expres-sion) relative to a wild-type or unmodified CD155 control by at least: 5%, 10%, 20%, 30%, 40%, 50%, 60%, 70%, 80%, 90%, or higher. In some embodiments, the wild-type CD155 control is murine CD155, such as would typically be used for a variant CD155 altered in sequence from that of a wild-type murine CD155 sequence. In some embodiments, the wild-type CD155 control is human CD155, such as would typically be used for a variant CD155 altered in sequence from that of a wild-type human CD155 sequence, such as an CD155 sequence comprising the sequence of amino acids of SEQ ID NO: 47, SEQ ID NO: 58 or SEQ ID NO: 155.

V. Pharmaceutical Formulations

Provided herein are compositions containing any of the variant CD155 polypeptides, immunomodulatory proteins, conjugates, engineered cells or infectious agents described herein. The pharmaceutical composition can further com-prise a pharmaceutically acceptable excipient. For example, the pharmaceutical composition can contain one or more excipients for modifying, maintaining or preserving, for example, the pH, osmolarity, viscosity, clarity, color, isoto-nicity, odor, sterility, stability, rate of dissolution or release, adsorption, or penetration of the composition. In some aspects, a skilled artisan understands that a pharmaceutical composition containing cells may differ from a pharmaceu-tical composition containing a protein.

In some embodiments, the pharmaceutical composition is a solid, such as a powder, capsule, or tablet. For example, the components of the pharmaceutical composition can be lyo-philized. In some embodiments, the solid pharmaceutical composition is reconstituted or dissolved in a liquid prior to administration.

In some embodiments, the pharmaceutical composition is a liquid, for example variant CD155 polypeptides dissolved in an aqueous solution (such as physiological saline or Ringer's solution). In some embodiments, the pH of the pharmaceutical composition is between about 4.0 and about 8.5 (such as between about 4.0 and about 5.0, between about 4.5 and about 5.5, between about 5.0 and about 6.0, between about 5.5 and about 6.5, between about 6.0 and about 7.0, between about 6.5 and about 7.5, between about 7.0 and about 8.0, or between about 7.5 and about 8.5).

In some embodiments, the pharmaceutical composition comprises a pharmaceutically-acceptable excipient, for example a filler, binder, coating, preservative, lubricant, flavoring agent, sweetening agent, coloring agent, a solvent, a buffering agent, a chelating agent, or stabilizer. Examples of pharmaceutically-acceptable fillers include cellulose, dibasic calcium phosphate, calcium carbonate, microcrys-talline cellulose, sucrose, lactose, glucose, mannitol, sorbi-tol, maltol, pregelatinized starch, corn starch, or potato starch. Examples of pharmaceutically-acceptable binders include polyvinylpyrrolidone, starch, lactose, xylitol, sorbi-tol, maltitol, gelatin, sucrose, polyethylene glycol, methyl cellulose, or cellulose. Examples of pharmaceutically-ac-ceptable coatings include hydroxypropyl methylcellulose (HPMC), shellac, corn protein zein, or gelatin. Examples of pharmaceutically-acceptable disintegrants include polyvi-nylpyrrolidone, carboxymethyl cellulose, or sodium starch glycolate. Examples of pharmaceutically-acceptable lubri-cants include polyethylene glycol, magnesium stearate, or stearic acid. Examples of pharmaceutically-acceptable pre-servatives include methyl parabens, ethyl parabens, propyl paraben, benzoic acid, or sorbic acid. Examples of pharma-ceutically-acceptable sweetening agents include sucrose, saccharine, aspartame, or sorbitol. Examples of pharmaceu-tically-acceptable buffering agents include carbonates, cit-rates, gluconates, acetates, phosphates, or tartrates.

In some embodiments, the pharmaceutical composition further comprises an agent for the controlled or sustained release of the product, such as injectable microspheres, bio-erodible particles, polymeric compounds (polylactic acid, polyglycolic acid), beads, or liposomes.

In some embodiments, the pharmaceutical composition is sterile. Sterilization may be accomplished by filtration through sterile filtration membranes or radiation. Where the composition is lyophilized, sterilization using this method may be conducted either prior to or following lyophilization and reconstitution. The composition for parenteral admin-istration may be stored in lyophilized form or in solution. In addition, parenteral compositions generally are placed into a container having a sterile access port, for example, an intravenous solution bag or vial having a stopper pierceable by a hypodermic injection needle.

In some embodiments, provided are pharmaceutical com-positions containing the transmembrane immunomodulatory proteins, including engineered cells expressing such trans-membrane immunomodulatory proteins. In some embodi-ments, the pharmaceutical compositions and formulations include one or more optional pharmaceutically acceptable carrier or excipient. Such compositions may comprise buf-fers such as neutral buffered saline, phosphate buffered saline and the like; carbohydrates such as glucose, mannose, sucrose or dextrans, mannitol; proteins; polypeptides or amino acids such as glycine; antioxidants; chelating agents such as EDTA or glutathione; adjuvants (e.g., aluminum hydroxide); and preservatives. Compositions of the present invention are preferably formulated for intravenous admin-istration.

In some embodiments, the pharmaceutical composition contains infectious agents containing nucleic acid sequences encoding the immunomodulatory variant polypeptides. In some embodiments, the pharmaceutical composition contains a dose of infectious agents suitable for administration to a subject that is suitable for treatment. In some embodiments, the pharmaceutical composition contains an infectious agent that is a virus, at a single or multiple dosage amount, of between about between or between about $1 \times 10^5$ and about $1 \times 10^{12}$ plaque-forming units (pfu), $1 \times 10^6$ and $1 \times 10^{10}$ pfu, or $1 \times 10^7$ and $1 \times 10^{10}$ pfu, each inclusive, such as at least or at least about or at about $1 \times 10^6$, $1 \times 10^7$, $1 \times 10^8$, $1 \times 10^9$, $2 \times 10^9$, $3 \times 10^9$, $4 \times 10^9$, $5 \times 10^9$ pfu or about $1 \times 10^{10}$ pfu. In some embodiments, the pharmaceutical composition can contain a virus concentration of from or from about $10^5$ to about $10^{10}$ pfu/mL, for example, $5 \times 10^6$ to $5 \times 10^9$ or $1 \times 10^7$ to $1 \times 10^9$ pfu/mL, such as at least or at least about or at about $10^6$ pfu/mL, $10^7$ pfu/mL, $10^8$ pfu/mL or $10^9$ pfu/mL. In some embodiments, the pharmaceutical composition contains an infectious agent that is a bacterium, at a single or multiple dosage amount, of between about between or between about $1 \times 10^3$ and about $1 \times 10^9$ colony-forming units (cfu), $1 \times 10^4$ and $1 \times 10^9$ cfu, or $1 \times 10^5$ and $1 \times 10^7$ cfu, each inclusive, such as at least or at least about or at about $1 \times 10^4$, $1 \times 10^5$, $1 \times 10^6$, $1 \times 10^7$, $1 \times 10^8$ or $1 \times 10^9$ cfu. In some embodiments, the pharmaceutical composition can contain a bacterial concentration of from or from about $10^3$ to about $10^8$ cfu/mL, for example, $5 \times 10^5$ to $5 \times 10^7$ or $1 \times 10^6$ to $1 \times 10^7$ cfu/mL, such as at least or at least about or at about $10^5$ cfu/mL, $10^6$ cfu/mL, $10^7$ cfu/mL or $10^8$ cfu/mL Such a formulation may, for example, be in a form suitable for intravenous infusion. A pharmaceutically acceptable carrier may be a pharmaceutically acceptable material, composition, or vehicle that is involved in carrying or transporting cells of interest from one tissue, organ, or portion of the body to another tissue, organ, or portion of the body. For example, the carrier may be a liquid or solid filler, diluent, excipient, solvent, or encapsulating material, or some combination thereof. Each component of the carrier must be "pharmaceutically acceptable" in that it must be compatible with the other ingredients of the formulation. It also must be suitable for contact with any tissue, organ, or portion of the body that it may encounter, meaning that it must not carry a risk of toxicity, irritation, allergic response, immunogenicity, or any other complication that excessively outweighs its therapeutic benefits.

In some embodiments, the pharmaceutical composition is administered to a subject. Generally, dosages and routes of administration of the pharmaceutical composition are determined according to the size and condition of the subject, according to standard pharmaceutical practice. For example, the therapeutically effective dose can be estimated initially either in cell culture assays or in animal models such as mice, rats, rabbits, dogs, pigs, or monkeys. An animal model may also be used to determine the appropriate concentration range and route of administration. Such information can then be used to determine useful doses and routes for administration in humans. The exact dosage will be determined in light of factors related to the subject requiring treatment. Dosage and administration are adjusted to provide sufficient levels of the active compound or to maintain the desired effect. Factors that may be taken into account include the severity of the disease state, the general health of the subject, the age, weight, and gender of the subject, time and frequency of administration, drug combination(s), reaction sensitivities, and response to therapy.

Long-acting pharmaceutical compositions may be administered every 3 to 4 days, every week, or biweekly depending on the half-life and clearance rate of the particular formulation. The frequency of dosing will depend upon the pharmacokinetic parameters of the molecule in the formulation used. Typically, a composition is administered until a dosage is reached that achieves the desired effect. The composition may therefore be administered as a single dose, or as multiple doses (at the same or different concentrations/dosages) over time, or as a continuous infusion. Further refinement of the appropriate dosage is routinely made. Appropriate dosages may be ascertained through use of appropriate dose-response data. A number of biomarkers or physiological markers for therapeutic effect can be monitored including T cell activation or proliferation, cytokine synthesis or production (e.g., production of TNF-$\alpha$, IFN-$\gamma$, IL-2), induction of various activation markers (e.g., CD25, IL-2 receptor), inflammation, joint swelling or tenderness, serum level of C-reactive protein, anti-collagen antibody production, and/or T cell-dependent antibody response(s).

In some embodiments, the pharmaceutical composition is administered to a subject through any route, including orally, transdermally, by inhalation, intravenously, intra-arterially, intramuscularly, direct application to a wound site, application to a surgical site, intraperitoneally, by suppository, subcutaneously, intradermally, transcutaneously, by nebulization, intrapleurally, intraventricularly, intra-articularly, intraocularly, or intraspinally.

In some embodiments, the dosage of the pharmaceutical composition is a single dose or a repeated dose. In some embodiments, the doses are given to a subject once per day, twice per day, three times per day, or four or more times per day. In some embodiments, about 1 or more (such as about 2 or more, about 3 or more, about 4 or more, about 5 or more, about 6 or more, or about 7 or more) doses are given in a week. In some embodiments, multiple doses are given over the course of days, weeks, months, or years. In some embodiments, a course of treatment is about 1 or more doses (such as about 2 or more does, about 3 or more doses, about 4 or more doses, about 5 or more doses, about 7 or more doses, about 10 or more doses, about 15 or more doses, about 25 or more doses, about 40 or more doses, about 50 or more doses, or about 100 or more doses).

In some embodiments, an administered dose of the pharmaceutical composition is about 1 μg of protein per kg subject body mass or more (such as about 2 μg of protein per kg subject body mass or more, about 5 μg of protein per kg subject body mass or more, about 10 μg of protein per kg subject body mass or more, about 25 μg of protein per kg subject body mass or more, about 50 μg of protein per kg subject body mass or more, about 100 μg of protein per kg subject body mass or more, about 250 μg of protein per kg subject body mass or more, about 500 pg of protein per kg subject body mass or more, about 1 mg of protein per kg subject body mass or more, about 2 mg of protein per kg subject body mass or more, or about 5 mg of protein per kg subject body mass or more).

In some embodiments, a therapeutic amount of a cell composition is administered. Typically, precise amount of the compositions of the present invention to be administered can be determined by a physician with consideration of individual differences in age, weight, tumor size, extent of infection or metastasis, and condition of the patient (subject). It can generally be stated that a pharmaceutical composition comprising engineered cells, e.g. T cells, as described herein may be administered at a dosage of $10^4$ to $10^9$ cells/kg body weight, such as $10^5$ to $10^6$ cells/kg body weight, including all integer values within those ranges. Engineered cell compositions, such as T cell compositions, may also be administered multiple times at these dosages. The cells can be administered by using infusion techniques that are commonly known in immunotherapy (see, e.g., Rosenberg et al, New Eng. J. of Med. 319: 1676, 1988). The optimal dosage and treatment regime for a particular patient can readily be determined by one skilled in the art of medicine by monitoring the patient for signs of disease and adjusting the treatment accordingly.

A variety of means are known for determining if administration of a therapeutic composition of the invention sufficiently modulates immunological activity by eliminating, sequestering, or inactivating immune cells mediating or capable of mediating an undesired immune response; inducing, generating, or turning on immune cells that mediate or are capable of mediating a protective immune response; changing the physical or functional properties of immune cells; or a combination of these effects. Examples of measurements of the modulation of immunological activity include, but are not limited to, examination of the presence or absence of immune cell populations (using flow cytometry, immunohistochemistry, histology, electron microscopy, polymerase chain reaction (PCR)); measurement of the functional capacity of immune cells including ability or resistance to proliferate or divide in response to a signal (such as using T-cell proliferation assays and pepscan analysis based on 3H-thymidine incorporation following stimulation with anti-CD3 antibody, anti-T-cell receptor antibody, anti-CD28 antibody, calcium ionophores, PMA (phorbol 12-myristate 13-acetate) antigen presenting cells loaded with a peptide or protein antigen; B cell proliferation assays); measurement of the ability to kill or lyse other cells (such as cytotoxic T cell assays); measurements of the cytokines, chemokines, cell surface molecules, antibodies and other products of the cells (e.g., by flow cytometry, enzyme-linked immunosorbent assays, Western blot analysis, protein microarray analysis, immunoprecipitation analysis); measurement of biochemical markers of activation of immune cells or signaling pathways within immune cells (e.g., Western blot and immunoprecipitation analysis of tyrosine, serine or threonine phosphorylation, polypeptide cleavage, and formation or dissociation of protein complexes; protein array analysis; DNA transcriptional, profiling using DNA arrays or subtractive hybridization); measurements of cell death by apoptosis, necrosis, or other mechanisms (e.g., annexin V staining, TUNEL assays, gel electrophoresis to measure DNA laddering, histology; fluorogenic caspase assays, Western blot analysis of caspase substrates); measurement of the genes, proteins, and other molecules produced by immune cells (e.g., Northern blot analysis, polymerase chain reaction, DNA microarrays, protein microarrays, 2-dimensional gel electrophoresis, Western blot analysis, enzyme linked immunosorbent assays, flow cytometry); and measurement of clinical symptoms or outcomes such as improvement of autoimmune, neurodegenerative, and other diseases involving self-proteins or self-polypeptides (clinical scores, requirements for use of additional therapies, functional status, imaging studies) for example, by measuring relapse rate or disease severity (using clinical scores known to the ordinarily skilled artisan) in the case of multiple sclerosis, measuring blood glucose in the case of type I diabetes, or joint inflammation in the case of rheumatoid arthritis.

VI. Articles of Manufacture and Kits

Also provided herein are articles of manufacture comprising the pharmaceutical compositions described herein in suitable packaging. Suitable packaging for compositions (such as ophthalmic compositions) described herein are known in the art, and include, for example, vials (such as sealed vials), vessels, ampules, bottles, jars, flexible packaging (e.g., sealed Mylar or plastic bags), and the like. These articles of manufacture may further be sterilized and/or sealed.

Further provided are kits comprising the pharmaceutical compositions (or articles of manufacture) described herein, which may further comprise instruction(s) on methods of using the composition, such as uses described herein. The kits described herein may also include other materials desirable from a commercial and user standpoint, including other buffers, diluents, filters, needles, syringes, and package inserts with instructions for performing any methods described herein.

VII. Therapeutic Applications

The pharmaceutical compositions described herein (including pharmaceutical composition comprising the variant CD155 polypeptides, the immunomodulatory proteins, the conjugates, and the engineered cells described herein) can be used in a variety of therapeutic applications, such as the treatment of a disease. For example, in some embodiments the pharmaceutical composition is used to treat inflammatory or autoimmune disorders, cancer, organ transplantation, viral infections, and/or bacterial infections in a mammal. The pharmaceutical composition can modulate an immune response to treat the disease.

In some embodiments, the provided methods are applicable to therapeutic administration of variant CD155 polypeptides, the immunomodulatory proteins, the conjugates, the engineered cells and infectious agents described herein. It is within the level of a skilled artisan, in view of the provided disclosure, to choose a format for the indication depending on the type of modulation of the immune response, e.g. increase or decrease that is desired.

In some embodiments, a pharmaceutical composition provided herein that stimulates the immune response is administered, which can be useful, for example, in the treatment of cancer, viral infections, or bacterial infections. In some embodiments, the pharmaceutical composition contains a variant CD155 polypeptide in a format that exhibits antagonist activity of its cognate binding partner TIGIT and/or that inhibits signaling via TIGIT. Exemplary formats of CD155 polypeptide for use in connection with such therapeutic applications include, for example, a variant CD155 polypeptide that is soluble (e.g. variant CD155-Fc fusion protein), an immunomodulatory protein or "stack" of a variant CD155 polypeptide and another IgSF domain, including soluble forms thereof that are Fc fusions, an engineered cell expressing a secretable immunomodulatory protein, or an infectious agent comprising a nucleic acid molecule encoding a secretable immunomodulatory protein, such as for expression and secretion of the secretable immunomodulatory protein in an infected cell (e.g. tumor cell or APC, e.g. dendritic cell).

In some embodiments, the pharmaceutical composition can be used to inhibit growth of mammalian cancer cells (such as human cancer cells). A method of treating cancer can include administering an effective amount of any of the pharmaceutical compositions described herein to a subject with cancer. The effective amount of the pharmaceutical composition can be administered to inhibit, halt, or reverse progression of cancers, including cancers that are sensitive to modulation of immunological activity, such as by the provided variants or immunomodulatory proteins. Human cancer cells can be treated in vivo, or ex vivo. In ex vivo treatment of a human patient, tissue or fluids containing cancer cells are treated outside the body and then the tissue or fluids are reintroduced back into the patient. In some embodiments, the cancer is treated in a human patient in vivo by administration of the therapeutic composition into the patient. Thus, the present invention provides ex vivo and in vivo methods to inhibit, halt, or reverse progression of the tumor, or otherwise result in a statistically significant increase in progression-free survival (i.e., the length of time during and after treatment in which a patient is living with cancer that does not get worse), or overall survival (also called "survival rate;" i.e., the percentage of people in a study or treatment group who are alive for a certain period of time after they were diagnosed with or treated for cancer) relative to treatment with a control.

The cancers that can be treated by the pharmaceutical compositions and the treatment methods described herein include, but are not limited to, melanoma, bladder cancer, hematological malignancies (leukemia, lymphoma, myeloma), liver cancer, brain cancer, renal cancer, breast cancer, pancreatic cancer (adenocarcinoma), colorectal cancer, lung cancer (small cell lung cancer and non-small-cell lung cancer), spleen cancer, cancer of the thymus or blood cells (i.e., leukemia), prostate cancer, testicular cancer, ovarian cancer, uterine cancer, gastric carcinoma, a musculoskeletal cancer, a head and neck cancer, a gastrointestinal cancer, a germ cell cancer, or an endocrine and neuroendocrine cancer. In some embodiments, the cancer is Ewing's sarcoma. In some embodiments, the cancer is selected from melanoma, lung cancer, bladder cancer, and a hematological malignancy. In some embodiments, the cancer is a lymphoma, lymphoid leukemia, myeloid leukemia, cervical cancer, neuroblastoma, or multiple myeloma.

In some embodiments, the pharmaceutical composition is administered as a monotherapy (i.e., as a single agent) or as a combination therapy (i.e., in combination with one or more additional anticancer agents, such as a chemotherapeutic drug, a cancer vaccine, or an immune checkpoint inhibitor. In some embodiments, the pharmaceutical composition can also be administered with radiation therapy. In some aspects of the present disclosure, the immune checkpoint inhibitor is nivolumab, tremelimumab, pembrolizumab, ipilimumab, or the like.

In some embodiments, the pharmaceutical composition suppresses an immune response, which can be useful in the treatment of inflammatory or autoimmune disorders, or organ transplantation. In some embodiments, the pharmaceutical composition contains a variant CD155 polypeptide in a format that exhibits agonist activity of its cognate binding partner TIGIT and/or that stimulates inhibitory signaling via TIGIT. Exemplary formats of a CD155 polypeptide for use in connection with such therapeutic applications include, for example, an immunomodulatory protein or "stack" of a variant CD155 polypeptide and an IgSF domain or variant thereof that localizes to a cell or tissue of an inflammatory environment, a conjugate containing a variant CD155 polypeptide linked to a moiety that localizes to a cell or tissue of an inflammatory environment, an engineered cell expressing a transmembrane immunomodulatory protein, or an infectious agent comprising a nucleic acid molecule encoding a transmembrane immunomodulatory protein, such as for expression of the transmembrane immunomodulatory protein in an infected cell.

In some embodiments, the inflammatory or autoimmune disorder is antineutrophil cytoplasmic antibodies (ANCA)-associated vasculitis, a vasculitis, an autoimmune skin disease, transplantation, a Rheumatic disease, an inflammatory gastrointestinal disease, an inflammatory eye disease, an inflammatory neurological disease, an inflammatory pulmonary disease, an inflammatory endocrine disease, or an autoimmune hematological disease.

In some embodiments, the inflammatory and autoimmune disorders that can be treated by the pharmaceutical composition described herein is Addison's Disease, allergies, alopecia areata, Alzheimer's, antineutrophil cytoplasmic antibodies (ANCA)-associated vasculitis, ankylosing spondylitis, antiphospholipid syndrome (Hughes Syndrome), asthma, atherosclerosis, rheumatoid arthritis, autoimmune hemolytic anemia, autoimmune hepatitis, autoimmune inner ear disease, autoimmune lymphoproliferative syndrome, autoimmune myocarditis, autoimmune oophoritis, autoimmune orchitis, azoospermia, Behcet's Disease, Berger's Disease, bullous pemphigoid, cardiomyopathy, cardiovascular disease, celiac Sprue/coeliac disease, chronic fatigue immune dysfunction syndrome (CFIDS), chronic idiopathic polyneuritis, chronic inflammatory demyelinating, polyradicalneuropathy (CIDP), chronic relapsing polyneuropathy (Guillain-Barré syndrome), Churg-Strauss Syndrome (CSS), cicatricial pemphigoid, cold agglutinin disease (CAD), COPD (chronic obstructive pulmonary disease), CREST syndrome, Crohn's disease, dermatitis, herpetiformus, dermatomyositis, diabetes, discoid lupus, eczema, epidermolysis bullosa acquisita, essential mixed cryoglobulinemia, Evan's Syndrome, exopthalmos, fibromyalgia, Goodpasture's Syndrome, Graves' Disease, Hashimoto's thyroiditis, idiopathic pulmonary fibrosis, idiopathic thrombocytopenia purpura (ITP), IgA nephropathy, immunoproliferative disease or disorder, inflammatory bowel disease (IBD), interstitial lung disease, juvenile arthritis, juvenile idiopathic arthritis (JIA), Kawasaki's Disease, Lambert-Eaton Myasthenic Syndrome, lichen planus, lupus nephritis, lymphocytic hypophysitis, Meniere's Disease, Miller Fish Syndrome/acute disseminated encephalomyeloradiculopathy, mixed connective tissue disease, multiple sclerosis (MS), muscular rheumatism, myalgic encephalomyelitis (ME), myasthenia gravis, ocular inflammation, *Pemphigus foliaceus*, pemphigus vulgaris, pernicious anaemia, polyarteritis nodosa, polychondritis, polyglandular syndromes (Whitaker's syndrome), polymyalgia rheumatica, polymyositis, primary agammaglobulinemia, primary biliary cirrhosis/autoimmune cholangiopathy, psoriasis, psoriatic arthritis, Raynaud's Phenomenon, Reiter's Syndrome/reactive arthritis, restenosis, rheumatic fever, rheumatic disease, sarcoidosis, Schmidt's syndrome, scleroderma, Sjörgen's Syndrome, stiff-man syndrome, systemic lupus erythematosus (SLE), systemic scleroderma, Takayasu arteritis, temporal arteritis/giant cell arteritis, thyroiditis, Type 1 diabetes, ulcerative colitis, uveitis, vasculitis, vitiligo, interstitial bowel disease or Wegener's Granulomatosis. In some embodiments, the inflammatory or autoimmune disorder is selected from interstitial bowel disease, transplant, Crohn's disease, ulcerative colitis, multiple sclerosis, asthma, rheumatoid arthritis, and psoriasis.

In some embodiments, the pharmaceutical composition is administered to modulate an autoimmune condition. For example, suppressing an immune response can be beneficial in methods for inhibiting rejection of a tissue, cell, or organ transplant from a donor by a recipient. Accordingly, in some embodiments, the pharmaceutical compositions described herein are used to limit or prevent graft-related or transplant related diseases or disorders, such as graft versus host disease (GVHD). In some embodiments, the pharmaceutical compositions are used to suppress autoimmune rejection of transplanted or grafted bone marrow, organs, skin, muscle, neurons, islets, or parenchymal cells.

Pharmaceutical compositions comprising engineered cells and the methods described herein can be used in adoptive cell transfer applications. In some embodiments, cell compositions comprising engineered cells can be used in associated methods to, for example, modulate immunological activity in an immunotherapy approach to the treatment of, for example, a mammalian cancer or, in other embodiments the treatment of autoimmune disorders. The methods employed generally comprise a method of contacting a TIP of the present invention with a mammalian cell under conditions that are permissive to specific binding of the affinity modified IgSF domain and modulation of the immunological activity of the mammalian cell. In some embodiments, immune cells (such as tumor infiltrating lymphocytes (TILs), T-cells (including CD8+ or CD4+ T-cells), or APCs) are engineered to express as a membrane protein and/or as a soluble variant CD155 polypeptide, immunomodulatory protein, or conjugate as described herein. The engineered cells can then be contact a mammalian cell, such as an APC, a second lymphocyte or tumor cell in which modulation of immunological activity is desired under conditions that are permissive of specific binding of the affinity modified IgSF domain to a counter-structure on the mammalian cell such that immunological activity can be modulated in the mammalian cell. Cells can be contacted in vivo or ex vivo.

In some embodiments, the engineered cells are autologous cells. In other embodiments, the cells are allogeneic. In some embodiments, the cells are autologous engineered cells reinfused into the mammal from which it was isolated. In some embodiments, the cells are allogenic engineered cells infused into the mammal. In some embodiments, the cells are harvested from a patient's blood or tumor, engineered to express a polypeptide (such as the variant CD155 polypeptide, immunomodulatory protein, or conjugate as described herein), expanded in an in vitro culture system (for example, by stimulating the cells), and reinfused into the patient to mediate tumor destruction. In some embodiments, the methods is conducted by adoptive cell transfer wherein cells expressing the TIP (e.g., a T-cell) are infused back into the patient. In some embodiments, the therapeutic compositions and methods of the invention are used in the treatment of a mammalian patient of cancers such as lymphoma, lymphoid leukemia, myeloid leukemia, cervical cancer, neuroblastoma, or multiple myeloma.

VIII. Exemplary Embodiments

Among the provided embodiments are:
1. A variant CD155 polypeptide, comprising an IgV domain or a specific binding fragment thereof, an IgC domain or a specific binding fragment thereof, or both, wherein the variant CD155 polypeptide comprises one or more amino acid modifications in an unmodified CD155 or a specific binding fragment thereof corresponding to position(s) selected from 7, 8, 9, 10, 11, 12, 13, 15, 16, 18, 19, 20, 21, 22, 23, 24, 25, 26, 29, 30, 32, 33, 34, 35, 36, 37, 38, 39, 40, 41, 42, 44, 45, 46, 47, 48, 49, 50, 51, 52, 53, 54, 55, 56, 57, 58, 59, 60, 61, 62, 64, 65, 67, 68, 69, 70, 72, 73, 75, 76, 77, 78, 79, 80, 81, 82, 83, 84, 85, 87, 88, 89, 90, 91, 92, 94, 95, 96, 97, 98, 99, 100, 102, 104, 106, 107, 108, 110, 111, 112, 113, 114, 115, or 116 with reference to positions set forth in SEQ ID NO:47.

2. The variant CD155 polypeptide of embodiment 1, wherein the amino acid modifications comprise amino acid substitutions, deletions or insertions.
3. The variant CD155 polypeptide of embodiment 1 or embodiment 2, wherein the unmodified CD155 is a mammalian CD155 or a specific binding fragment thereof.
4. The variant CD155 polypeptide of embodiment 3, wherein the unmodified CD155 is a human CD155 or a specific binding fragment thereof.
5. The variant CD155 polypeptide of any one of embodiments 1-4, wherein the unmodified CD155 comprises (i) the sequence of amino acids set forth in SEQ ID NO:47, (ii) a sequence of amino acids that has at least 95% sequence identity to SEQ ID NO:47; or (iii) a portion thereof comprising an IgV domain or specific binding fragment thereof.
6. The variant CD155 polypeptide of any one of embodiments 1-5, wherein:
the specific binding fragment of the IgV domain has a length of at least 50, 60, 70, 80, 90, 100, 110 or more amino acids; or
the specific binding fragment of the IgV domain comprises a length that is at least 80% of the length of the IgV domain set forth as amino acids 24-139 of SEQ ID NO:20.
7. The variant CD155 polypeptide of any one of embodiments 1-6, wherein the variant CD155 comprises up to 1, 2, 3, 4, 5, 6, 7, 8, 9, 10, 11, 12, 13, 14, 15, 16, 17, 18, 19 or 20 amino acid modifications, optionally amino acid substitutions, insertions and/or deletions.
8. The variant CD155 of any of embodiments 1-7, wherein the variant CD155 comprises a sequence of amino acids that exhibits at least 85%, 86%, 87%, 88%, 89%, 90%, 91%, 92%, 93%, 94%, 95%, 96%, 97%, 98% or 99% sequence identity to SEQ ID NO:47 or a specific binding fragment thereof.
9. The variant CD155 polypeptide of any of embodiments 1-8, wherein the variant CD155 polypeptide exhibits altered binding to the ectodomain of TIGIT, CD226 or CD96 compared to the unmodified CD155.
10. The variant CD155 polypeptide of any of embodiments 1-9, wherein the variant CD155 polypeptide exhibits altered binding to the ectodomain of TIGIT or CD226 compared to the unmodified CD155.
11. The variant CD155 polypeptide of embodiment 9 or embodiment 10, wherein the altered binding is altered binding affinity and/or altered binding selectivity.
12. The variant CD155 polypeptide of any of embodiments 1-11, wherein the one or more amino acid modifications are selected from G7E, D8G, V9A, V9D, V9I, V9L, V10F, V10G, V10I, V11A, V11E, V11M, Q12H, Q12K, Q12L, A13E, A13R, T15I, T15S, Q16H, P18C, P18F, P18H, P18L, P18S, P18T, P18Y, G19D, F20I, F20S, F20Y, L21S, L21M, G22S, D23A, D23G, D23N, D23Y, S24A, S24P, V25A, V25E, T26M, C29R, Y30C, Y30F, Y30H, Q32L, Q32R, V33M, P34S, N35D, N35F, N35S, M36I, M36R, M36T, E37G, E37P, E37S, E37V, V38A, V38G, T39A, T39S, H40Q, H40R, H40T, V41A, V41M, S42A, S42C, S42G, S42L, S42N, S42P, S42Q, S42T, S42V, S42W, L44P, L44V, T45A, T45G, T45I, T45S, T45Q, T45V, W46C, W46R, A47E, A47G, A47V, R48Q, H49L, H49Q, H49R, G50S, E51G, E51K, E51V, S52A, S52E, S52G, S52K, S52L, S52M, S52P, S52Q, S52R, S52T, S52W, G53R, S54C, S54G, S54H, S54N, S54R, M55I, M55L, M55V, A56V, V57A, V57L, V57T, F58L, F58Y, H59E, H59N, N59R, Q60H, Q60K, Q60P, Q60R, T61A, T61G, T61K, T61M, T61R, T61S, Q62F, Q62H, Q62K, Q62L, Q62M, Q62R, Q62Y, P64S, S65A, S65C, S65G, S65D, S65T, S65Y, S65H, S65N, S65T, S65W, S67A, S67E, S67G, S67H, S67L, S67T, S67V, S67W, E68D, E68G, S69L, S69P, K70E, K70R, K70Q, L72Q, E73D, E73G, E73R, V75A, V75L, A76E, A76G, A76T, A77T, A77V, R78G, R78K, R78S, L79P, L79Q, L79V, G80D, G80S, A81E, A81P, A81T, A81V, E82D, E82G, L83P, L83Q, R84W, N85D, N85Y, N87T, L88P, R89K, M90I, M90L, M90V, F91S, F91T, F91P, G92A, G92E, G92W, R94H, V95A, E96D, D97G, E98D, E98S, G99D, G99Y, N100Y, T102S, L104E, L104M, L104N, L104P, L104Q, L104T, L104Y, V106A, V106I, V106L, T107A, T107L, T107M, T107S, T107V, F108H, F108L, F108Y, Q110R, G111D, G111R, S112I, S112N, S112V, R113G, R113W, S114N, S114T, V115A, V115M, D116G, or D116N, or a conservative amino acid substitution thereof.

13. The variant CD155 polypeptide of any of embodiments 1-12, comprising one or more amino acid modifications selected from P18S/P64S/F91S, P18S/F91S/L104P, P18L/L79V/F91S, P18S/F91S, P18T/F91S, P18T/S42P/F91S, G7E/P18T/Y30C/F91S, P18T/F91S/G111D, P18S/F91P, P18T/F91S/F108L, P18S/F91S, P18T/T45A/F91S, P18T/F91S/R94H, P18S/Y30C/F91S, A81V/L83P, A13E/P18S/A56V/F91S, P18T/F91S/V115A, P18T/Q60K, S52M, T45Q/S52L/L104E/G111R, S42G, Q62F, S52Q, S42A/L104Q/G111R, S42A/S52Q/L104Q/G111R, S52W/L104E, S42C, S52W, S52M/L104Q, S42L/S52L/Q62F/L104Q, S42W, S42Q, S52L, S52R, L104E, G111R, S52E, Q62Y, T45Q/S52M/L104E, S42N/L104Q/G111R, S52M/V57L, S42N/S52Q/Q62F, S42A/S52L/L104E/G111R, S42W/S52Q/V57L/Q62Y, L104Q, S42L/S52Q/L104E, S42C/S52L, S42W/S52R/Q62Y/L104Q, T45Q/S52R/L104E, S52R/Q62F/L104Q/G111R, T45Q/S52L/V57L/L104E, S52M/Q62Y, Q62F/L104E/G111R, T45Q/S52Q, S52L/L104E, S42V/S52E, T45Q/S52R/G111R, S42G/S52Q/L104E/G111R, S42N/S52E/V57L/L104E, S42C/S52M/Q62F, S42L, S42A, S42G/S52L/Q62F/L104Q, S42N, P18T/S65A/S67V/F91S, P18F/T39A/T45Q/T61R/S65N/S67L/E73G/R78G, P18T/T45Q/T61R/S65N/S67L, P18F/S65A/S67V/F91S, P18F/T45Q/T61R/S65N/S67L/F91S/L104P, P18S/L79P/L104M, P18S/L104M, L79P/L104M, P18T/T45Q/L79P, P18T/T45Q/T61R/S65H/S67H, P18T/A81E, P18S/D23Y/E37P/S52G/Q62M/G80S/A81P/G99Y/S112N, A13R/D23Y/E37P/S42P/Q62Y/A81E, A13R/D23Y/E37P/G99Y/S112N, A13R/D23Y/E37P/Q62M/A77V/G80S/A81P/G99Y, P18L/E37S/Q62M/G80S/A81P/G99Y/S112N, P18S/L104T, P18S/Q62H/L79Q/F91S, T45Q/S52K/Q62F/L104Q/G111R, T45Q/S52Q/Q62Y/L104Q/G111R, T45Q/S52Q/Q62Y/L104E/G111R, V57A/T61M/S65W/S67A/E96D/L104T, P18L/V57T/T61S/S65Y/S67A/L104T, P18T/T45Q, P18L/V57A/T61M/S65W/S67A/L104T, T61M/S65W/S67A/L104T, P18S/V41A/S42G/T45G/L104N, P18H/S42G/T45I/S52T/G53R/S54H/V57L/H59E/T61S/S65D/E68G/L104N, P18S/S42G/T45V/F58L/S67W/L104N, P18S/T45I/L104N, P18S/S42G/T45G/L104N/V106A, P18H/H40R/S42G/T45I/S52T/G53R/S54H/V57L/H59E/T61S/S65D/E68G/L104Y/V106L/F108H, E37V/S42G/T45G/L104N, P18S/T45Q/L79P/L104T, P18L/Q62R, A13R/D23Y/E37P/S42L/S52G/Q62Y/A81E, P18L/H49R/L104T/D116N, A13R/D23Y/E37P/Q62M/G80S/

A81P/L104T, S65T/L104T, A13R/D23Y/E37P/S52G/V57A/Q62M/K70E/L104T, P18L/A47V/Q62Y/E73D/L104T, H40T/V411M/A47V/S52Q/Q62L/S65T/E73R/D97G/E98S/L104T/D116N, P18L/S42P/T45Q/T61G/S65H/S67E/L104T/D116N, P18S/H40T/V41M/A47V/S52Q/Q62L/S65T/E73R/L104M/V106A, H40T/V41M/A47V/S52Q/Q62L/S65T/E68G/E73R/D97G/E98S/L104T, T45Q/S52E/L104E, T45Q/S52E/Q62F/L104E, P18F/T26M/L44V/Q62K/L79P/F91S/L104M/G111D, P18S/T45S/T61K/S65W/S67A/F91S/G111R, P18S/L79P/L104M/T107M, P18S/S65W/S67A/M90V/V95A/L104Q/G111R, P18S/A47G/L79P/F91S/L104M/T107A/R113W, P18T/D23G/S24A/N35D/H49L/L79P/F91S/L104M/G111R, V9L/P18S/Q60R/V75L/L79P/R89K/F91S/L104E/G111R, P18S/H49R/E73D/L79P/N85D/F91S/V95A/L104M/G111R, V11A/P18S/L79P/F91S/L104M/G111R, V11A/P18S/S54R/Q60P/Q62K/L79P/N85D/F91S/T107M, P18T/S52P/S65A/S67V/L79P/F91S/L104M/G111R, P18T/M36T/L79P/F91S/G111R, D8G/P18S/M36I/V38A/H49Q/A76E/F91S/L104M/T107A/R113W, P18S/S52P/S65A/S67V/L79P/F91S/L104M/T107S/R113W, T15I/P18T/L79P/F91S/L104M/G111R, P18F/T26M/L44V/Q62K/L79P/E82D/F91S/L104M/G111D, P18T/E37G/G53R/Q62K/L79P/F91S/E98D/L104M/T107M, P18L/K70E/L79P/F91S/V95A/G111R, V9I/Q12K/P18F/S65A/S67V/L79P/L104T/G111R/S112I, P18F/S65A/S67V/F91S/L104M/G111R, V9I/V10I/P18S/F20S/T45A/L79P/F91S/L104M/F108Y/G111R/S112V, V9L/P18L/L79P/M90I/F91S/T102S/L104M/G111R, P18C/T26M/L44V/M55I/Q62K/L79P/F91S/L104M/T107M, V9I/P18T/D23G/L79P/F91S/G111R, P18F/L79P/M90L/F91S/V95A/L104M/G111R, P18T/M36T/S65A/S67E/L79Q/A81T/F91S/G111R, V9L/P18T/Q62R/L79P/F91S/L104M/G111R, P18S/S65W/S67A/L104Q/G111R, P18T/G19D/M36T/S54N/L79P/L83Q/F91S/T107M/F108Y, V9L/P18L/M55V/S69L/L79P/A81E/F91S/T107M, P18F/H40Q/T61K/Q62K/L79P/F91S/L104M/T107V, P18S/Q32R/Q62K/R78G/L79P/F91S/T107A/R113W, Q12H/P18T/L21S/G22S/V57A/Q62R/L79P/F91S/T107M, V9I/P18S/S24P/H49Q/F58Y/Q60R/Q62K/L79P/F91S/T107M, P18T/W46C/H49R/S65A/S67V/A76T/L79P/S87T/L104M, P18S/S42T/E51G/L79P/F91S/G92W/T107M, V10F/T15S/P18L/R48Q/L79P/F91S/T107MIV 115M, P18S/L21M/Y30F/N35D/R84W/F91S/T107M/D 116G, P18F/E51V/S54G/Q60R/L79Q/E82G/S87T/M901/F91S/G92R/T107M, Q16H/P18F/F91S/T107M, P18T/D23G/Q60R/S67L/L79P/F91S/T107M/V115A, D8G/V9I/V11A/P18T/T26M/S52P/L79P/F91S/G92A/T107L/V115A, V9I/P18F/A47E/G50S/E68G/L79P/F91S/T107M, P18S/M55I/Q62K/S69P/L79P/F91S/T107M, P18T/T39S/S52P/S54R/L79P/F91S/T107M, P18S/D23N/L79P/F91S/T107M/S114N, P18S/P34S/E51V/L79P/F91S/G111R, P18S/H59N/V75A/L79P/A81T/F91S/L104M/T107M, P18S/W46R/E68D/L79P/F91S/T107M/R113G, V9L/P18F/T45A/S65A/S67V/R78K/L79V/F91S/T107M/S114T, P18T/M55L/T61R/L79P/F91S/V106I/T107M, T15I/P18S/V33M/N35F/T39S/M55L/R78S/L79P/F91S/T107M, P18S/Q62K/K70E/L79P/F91S/G92E/R113W, P18F/F20I/T26M/A47V/E51K/L79P/F91S, P18T/D23A/Q60H/L79P/M90V/F91S/T107M, P18S/D23G/C29R/N35D/E37G/M55I/Q62K/S65A/S67G/R78G/L79P/F91S/L104M/T107M/Q110R, A13E/P18S/M36R/Q62K/S67T/L79P/N85D/F91S/T107M, V9I/P18T/H49R/L79P/N85D/F91S/L104T/T107M, V9A/P18F/T61S/

Q62L/L79P/F91S/G111R, D8E/P18T/T61A/L79P/ F91S/T107M, P18S/V41A/H49R/S54C/L79S/N85Y/ L88P/F91S/L104M/T107M, V 11E/P18H/F20Y/ V25E/N35H/H49R/L79P/F91S/T107M/G111R, V11A/ P18F/D23A/L79P/G80D/V95A/T107M, P18S/K70R/ L79P/F91S/G111R, V9L/V11M/P18S/N35S/S54G/ Q62K/L79P/L104M/T107M/V115M, V9L/P18Y/ V25A/V38G/M55V/A77T/L79P/M90I/F91S/L104M, V10G/P18T/L72Q/L79P/F91S/T107M, P18S/H59R/ A76G/R78S/L79P, V9A/P18S/M36T/S65G/L79P/ F91S/L104T/G111R/S112I, P18T/S52A/V57A/Q60R/ Q62K/S65C/L79P/F91T/N100Y/T107M, V11A/P18F/ N35D/A47E/Q62K/L79P/F91S/G99D/T107M/S114N, V11A/P18T/N35S/L79P/S87T/F91S, V9D/V11M/ Q12L/P18S/E37V/M55I/Q60R/K70Q/L79P/F91S/ L104M/T107M, or T15S/P18S/Y30H/Q32L/Q62R/ L79P/F91S/T107M.

14. The variant CD155 polypeptide of any of embodiments 1-13, wherein the variant CD155 polypeptide comprises one IgC domain or two IgC domains or a specific fragment thereof.

15. The variant CD155 polypeptide of any of embodiments 1-13, comprising the sequence of amino acids set forth in any of SEQ ID NOS: 59-80, 178-274, 1230-1252, 1269, and 1610-1655 or a specific binding fragment thereof, or a sequence of amino acids that exhibits at least 95% sequence identity to any of SEQ ID NOS: 59-80, 178-274, 1230-1252, 1269, and 1610-1655 or a specific binding fragment thereof and that contains the one or more of the amino acid modifications.

16. The variant CD155 polypeptide of any of embodiments 1-15, wherein the unmodified CD155 comprises an IgV domain or specific binding fragment thereof comprising (i) the sequence of amino acids set forth in SEQ ID NO:58 or 155, (ii) a sequence of amino acids that has at least 95% sequence identity to SEQ ID NO:58 or 155; or (iii) a portion thereof comprising a specific binding fragment thereof.

17. The variant CD155 polypeptide of any of embodiments 1-16, wherein the variant CD155 polypeptide comprises the IgV domain or a specific binding fragment thereof.

18. The variant CD155 polypeptide of any of embodiments 1-17, wherein the IgV domain or specific binding fragment thereof is the only CD155 portion of the variant CD155 polypeptide.

19. The variant CD155 polypeptide of any of embodiments 1-18, comprising the sequence of amino acids set forth in any of SEQ ID NOS: 81-102, 156-177, 275-468, 1184-1229, 1270-1271, 1656-1747 or a specific binding fragment thereof, a sequence of amino acids that exhibits at least 95% sequence identity to any of SEQ ID NOS: 81-102, 156-177, 275-468, 1184-1229, 1270-1271, 1656-1747 or a specific binding fragment thereof and that contains the one or more of the amino acid modifications.

20. The variant CD155 polypeptide of any of embodiments 1-19, wherein the variant CD155 polypeptide specifically binds to the ectodomain of one or more of TIGIT, CD226 or CD96 with increased affinity compared to the unmodified CD155.

21. The variant CD155 polypeptide of any of embodiments 1-20, wherein the variant CD155 polypeptide specifically binds to the ectodomain of TIGIT or CD226 with increased affinity compared to the unmodified CD155.

22. The variant CD155 polypeptide of any of embodiments 1-21, wherein the variant CD155 polypeptide specifically binds to the ectodomain of TIGIT and the ectodomain of CD226 each with increased affinity compared to the unmodified CD155.

23. The variant CD155 polypeptide of any of embodiments 1-20, wherein the variant CD155 polypeptide specifically binds to the ectodomain of one or more of TIGIT, CD226 or CD96 with increased affinity and specifically binds to the ectodomain of one or more of the other of TIGIT, CD226 or CD96 with decreased affinity compared to the unmodified CD155.

24. The variant CD155 polypeptide of embodiment 23, wherein the variant CD155 polypeptide specifically binds to the ectodomain of TIGIT with increased affinity and specifically binds to the ectodomain of CD226 with decreased affinity compared to the unmodified CD155.

25. The variant CD155 polypeptide of any of embodiments 1-24, wherein the variant polypeptide specifically binds to the ectodomain of TIGIT with increased selectivity compared to the unmodified CD155.

26. The variant CD155 polypeptide of embodiment 25, wherein the increased selectivity comprises a greater ratio of binding of the variant polypeptide for TIGIT versus CD226 compared to the ratio of binding of the unmodified CD155 polypeptide for TIGIT versus CD226.

27. The variant CD155 polypeptide of embodiment 26, wherein the ratio is greater by at least or at least about 1.5-fold, 2.0-fold, 3.0-fold, 4.0-fold, 5.0-fold, 10-fold, 15-fold, 20-fold, 30-fold, 40-fold, 50-fold or more.

28. The variant CD155 polypeptide of embodiment 23, wherein the variant CD155 polypeptide specifically binds to the ectodomain of CD226 with increased affinity and specifically binds to the ectodomain of TIGIT with decreased affinity compared to the unmodified CD155.

29. The variant CD155 polypeptide of any of embodiments 9-28, wherein the TIGIT is a human TIGIT.

30. The variant CD155 polypeptide of any of embodiments 9-29, wherein the CD226 is a human CD226.

31. The variant CD155 polypeptide of any of embodiments 9-30, wherein the CD96 is a human CD96.

32. The variant CD155 polypeptide of any of embodiments 1-31, wherein the binding activity is altered (increased or decreased) more than 1.2-fold, 1.5-fold, 2-fold, 3-fold, 4-fold, 5-fold, 6-fold, 7-fold, 8-fold, 9-fold, 10-fold, 20-fold, 30-fold 40-fold or 50-fold compared to the unmodified CD155.

33. The variant CD155 polypeptide of any of embodiments 1-32 that is a soluble protein.

34. The variant CD155 polypeptide of any of embodiments 1-33, wherein the variant CD155 polypeptide is linked to a multimerization domain.

35. The variant CD155 polypeptide of embodiment 34, wherein the multimerization domain is an Fe domain or a variant thereof with reduced effector function.

36. The variant CD155 polypeptide of any of embodiments 1-35, wherein the variant CD155 polypeptide is linked to a moiety that increases biological half-life of the polypeptide.

37. The variant CD155 polypeptide of any of embodiments 1-36, wherein the variant CD155 polypeptide is linked to an Fc domain or a variant thereof with reduced effector function.

38. The variant CD155 polypeptide of any of embodiments 37-39, wherein: the Fc domain is mammalian, optionally human; or the variant Fc domain comprises one or more amino acid modifications compared to an unmodified Fc domain that is mammalian, optionally human.

39. The variant CD155 polypeptide of any one of embodiments 35, 37 and 38, wherein the Fc domain or variant thereof comprises the sequence of amino acids set forth in SEQ ID NO:56 or SEQ ID NO:57 or a sequence of amino acids that exhibits at least 85% sequence identity to SEQ ID NO:56 or SEQ ID NO:57.

40. The variant CD155 polypeptide of any of embodiments 35 and 37-39, wherein the Fc domain comprises one or more amino acid modifications selected from among E233P, L234A, L234V, L235A, L235E, G236del, G237A, S267K, N297G, V302C, and K447del, each by EU numbering.

41. The variant CD155 polypeptide of any of embodiments 35 and 37-40, wherein the Fc domain comprises the amino acid modification C220S by EU numbering.

42. The variant CD155 polypeptide of any of embodiments 34-41, wherein the variant CD155 polypeptide is linked to the multimerization domain or Fc indirectly via a linker, optionally a G4S linker.

43. The variant CD155 polypeptide of any of embodiments 1-17 and 19-32, wherein the variant CD155 polypeptide is a transmembrane immunomodulatory protein further comprising a transmembrane domain linked to the extracellular domain (ECD) or specific binding fragment thereof of the variant CD155 polypeptide.

44. The variant CD155 polypeptide of embodiment 3, wherein the transmembrane domain comprises the sequence of amino acids set forth as residues 344-367 of SEQ ID NO:20 or a functional variant thereof that exhibits at least 85% sequence identity to residues 344-367 of SEQ ID NO:20.

45. The variant CD155 polypeptide of embodiment 43 or embodiment 44, further comprising a cytoplasmic domain linked to the transmembrane domain.

46. The variant CD155 polypeptide of embodiment 47, wherein the cytoplasmic signaling domain comprises the sequence of amino acids set forth as residues 368-417 of SEQ ID NO:20 or a functional variant thereof that exhibits at least 85% sequence identity to residues 368-417 of SEQ ID NO:20.

47. The variant CD155 polypeptide of any of embodiments 1-48, wherein the variant CD155 increases IFN-gamma (interferon-gamma) expression relative to the unmodified CD155 in an in vitro primary T-cell assay.

48. The variant CD155 polypeptide of any of embodiments 1-48, wherein the variant CD155 decreases IFN-gamma (interferon-gamma) expression relative to the unmodified CD155 in an in vitro primary T-cell assay.

49. The variant CD155 polypeptide of any of embodiments 1-50 that is deglycosylated.

50. An immunomodulatory protein, comprising the variant CD155 of any of embodiments 1-49 linked, directly or indirectly via a linker, to a second polypeptide comprising an immunoglobulin superfamily (IgSF) domain of an IgSF family member.

51. The immunomodulatory protein of embodiment 50, wherein the IgSF domain is an affinity-modified IgSF domain, said affinity-modified IgSF domain comprising one or more amino acid modifications compared to the unmodified or wild-type IgSF domain of the IgSF family member.

52. The immunomodulatory protein of embodiment 50 or embodiment 51, wherein the IgSF domain is affinity modified and exhibits altered binding to one or more of its cognate binding partner(s) compared to the unmodified or wild-type IgSF domain of the IgSF family member.

53. The immunomodulatory protein of embodiment 52, wherein the IgSF domain exhibits increased binding to one or more of its cognate binding partner(s) compared to the unmodified or wild-type IgSF domain.

54. The immunomodulatory protein of any one of embodiments 50-53, wherein the variant CD155 polypeptide is a first variant CD155 polypeptide and the IgSF domain of the second polypeptide is an IgSF domain from a second variant CD155 polypeptide of any of embodiments 1-49, wherein the first and second variant CD155 polypeptides are the same or different.

55. The immunomodulatory protein of any one of embodiments 50-54, wherein the variant CD155 polypeptide is capable of specifically binding to TIGIT or CD226 and the IgSF domain is capable of binding to a cognate binding partner other than one specifically bound by the variant CD155 polypeptide.

56. The immunomodulatory protein of any of embodiments 50-55, wherein the IgSF domain is from a member of the B7 family.

57. The immunomodulatory protein of any of embodiments 50-55, wherein the IgSF domain is a tumor-localizing moiety that binds to a ligand expressed on a tumor or is an inflammatory-localizing moiety that binds to a ligand expressed on a cell or tissue associated with an inflammatory environment.

58. The immunomodulatory protein of embodiment 57, wherein the ligand is B7H6.

59. The immunomodulatory polypeptide of embodiment 57 or embodiment 58, wherein the IgSF domain is from NKp30.

60. The immunomodulatory protein of any embodiments 50-55, wherein the IgSF domain of the second polypeptide is an IgSF domain of a ligand that binds to an inhibitory receptor, or is an affinity-modified IgSF domain thereof.

61. The immunomodulatory protein of embodiment 60, wherein the IgSF domain of the second polypeptide is an affinity-modified IgSF domain and the affinity-modified IgSF domain exhibits increased binding affinity and/or binding selectivity for the inhibitory receptor compared to binding of the unmodified IgSF domain to the inhibitory receptor.

62. The immunomodulatory protein of embodiment 60 or embodiment 61, wherein: the inhibitory receptor is TIGIT, CD112R, CTLA-4 or PD-1; or the ligand of the inhibitory receptor is CD112, CD80, PD-L1 or PD-L2.

63. The immunomodulatory protein of any of embodiments 50-55 and 60-61, wherein the second polypeptide is selected from:

(i) a variant CD80 polypeptide comprising an IgSF domain set forth in any of SEQ ID NOS: 896-928, 930-968, 970-1002, 1004-1042, 1044-1116;

(ii) a variant PD-L1 polypeptide comprising an IgSF domain set forth in any of SEQ ID NOS: 470-664, 1753-1755, 1757-2031;

(iii) a variant PD-L2 polypeptide comprising an IgSF domain set forth in any of SEQ ID NOS: 667-717, 719-725, 727-794, 796-870, 872-895;

(iv) a variant CD112 polypeptide comprising an IgSF domain set for in any of SEQ ID NOS: 1273-1366, 1368-1609;

(v) a sequence of amino acids that exhibits at least 90%, 91%, 92%, 93%, 94%, 95%, 95%, 97%, 98%, 99% or more sequence identity to any of the SEQ ID NOS in (i)-(iv) and that comprises the amino acid modifications, optionally amino acid substitutions, insertions and/or deletions; or (vi) a specific binding fragment of any of (i)-(v).

64. The immunomodulatory protein of any of embodiments 50-63, further comprising a third polypeptide comprising an IgSF domain of an IgSF family member or an affinity-modified IgSF domain thereof, said affinity-modified IgSF domain comprising one or more amino acid modifications compared to the unmodified or wild-type IgSF domain of the IgSF family member.

65. The immunomodulatory protein of embodiment 64, wherein:

the third polypeptide is the same as the first and/or second polypeptide; or the third polypeptide is different from the first and/or second polypeptide.

66. The immunomodulatory protein of embodiment 64 and embodiment 65, wherein the third polypeptide is selected from:

(i) a variant CD80 polypeptide comprising an IgSF domain set forth in any of SEQ ID NOS: 896-928, 930-968, 970-1002, 1004-1042, 1044-1116;

(ii) a variant PD-L1 polypeptide comprising an IgSF domain set forth in any of SEQ ID NOS: 470-664, 1753-1755, 1757-2031;

(iii) a variant PD-L2 polypeptide comprising an IgSF domain set forth in any of SEQ ID NOS: 667-717, 719-725, 727-794, 796-870, 872-895;

(iv) a variant CD112 polypeptide comprising an IgSF domain set for in any of SEQ ID NOS: 1273-1366, 1368-1609;

(v) a sequence of amino acids that exhibits at least 90%, 91%, 92%, 93%, 94%, 95%, 95%, 97%, 98%, 99% or more sequence identity to any of the SEQ ID NOS in (i)-(iv) and that comprises the amino acid modifications, optionally amino acid substitutions, insertions and/or deletions; or (vi) a specific binding fragment of any of (i)-(v).

67. The immunomodulatory protein of any of embodiments 50-65, wherein the IgSF domain or affinity-modified IgSF domain thereof, optionally of the second or third polypeptide, is or comprises an IgV domain.

68. The immunomodulatory protein of any of embodiments 50-67, wherein the variant CD155 polypeptide is or comprises an IgV domain.

69. The immunomodulatory protein of any of embodiments 64-68, further comprising at least one additional polypeptide comprising an IgSF domain of an IgSF family member or an affinity-modified IgSF domain thereof, said affinity-modified IgSF domain comprising one or more amino acid modifications compared to the unmodified or wild-type IgSF domain of the IgSF family member.

70. The immunomodulatory protein of any of embodiments 50-69, wherein the immunomodulatory protein further comprises a multimerization domain linked to at least one of the variant CD155 polypeptide, or the second polypeptide.

71. The immunomodulatory protein of any of embodiments 64-69, wherein the immunomodulatory protein further comprises a multimerization domain linked to at least one of the variant CD155 polypeptide, the second polypeptide and/or the third polypeptide.

72. The immunomodulatory protein of any of embodiments 69-71, wherein the multimerization domain is an Fc domain or a variant thereof with reduced effector function.

73. The immunomodulatory protein of any of embodiments 69-72, wherein the multimerization domain promotes heterodimer formation.

74. An immunomodulatory protein comprising a first variant CD155 polypeptide of any of embodiments 34-42 in which the multimerization domain is a first multimerization domain and a second variant CD155 polypeptide of any of embodiments 34-42 in which the multimerization domain is a second multimerization domain, wherein the first and second multimerization domains interact to form a multimer containing the first and second variant CD155 polypeptide.

75. An immunomodulatory protein comprising the immunomodulatory protein of any of embodiments 70-72, wherein the multimerization domain is a first multimerization domain and interacts with a second multimerization domain to form a multimer comprising the immunomodulatory protein.

76. The immunomodulatory protein of embodiment 75, wherein the immunomodulatory protein is a first immunomodulatory protein and a second immunomodulatory protein is linked directly or indirectly via a linker to the second multimerization domain, wherein the multimer comprises the first and second immunomodulatory protein.

77. The immunomodulatory protein of embodiment 76, wherein the second immunomodulatory protein is an immunomodulatory protein of any of embodiments 70-72.

78. The immunomodulatory protein of embodiment 74 or embodiment 75, wherein the multimer is a dimer.

79. The immunomodulatory protein of any of embodiments 74-78 that is a homodimer.

80. The immunomodulatory protein of any of embodiments 74-79 that is a heterodimer.

81. The immunomodulatory protein of any of embodiments 74-80, wherein the first and/or second multimerization domain is an Fc domain or a variant thereof with reduced effector function.

82. The immunomodulatory protein of any of embodiments 74-81, wherein the first and second multimerization domain is the same or different.

83. A conjugate, comprising a variant CD155 of any of embodiments 1-49 or an immunomodulatory protein of any of embodiments 50-72 linked to a moiety.

84. The conjugate of embodiment 83, wherein the moiety is a targeting moiety that specifically binds to a molecule on the surface of a cell.

85. The conjugate of embodiment 84, wherein the targeting moiety specifically binds to a molecule on the surface of an immune cell.

86. The conjugate of embodiment 85, wherein the immune cell is an antigen presenting cell or a lymphocyte.

87. The conjugate of embodiment 86, wherein the targeting moiety is a tumor-localizing moiety that binds to a molecule on the surface of a tumor.

88. The conjugate of any of embodiments 83-87, wherein the moiety is a protein, a peptide, nucleic acid, small molecule or nanoparticle.

89. The conjugate of any of embodiments 83-88, wherein the moiety is an antibody or antigen-binding fragment.

90. The conjugate of any of embodiments 83-89, wherein the conjugate is divalent, tetravalent, hexavalent or octavalent.

91. A nucleic acid molecule(s), encoding a variant CD155 polypeptide of any of embodiments 1-49 or an immunomodulatory protein of any of embodiments 50-72.

92. The nucleic acid molecule of embodiment 91 that is synthetic nucleic acid.

93. The nucleic acid molecule of embodiment 91 or embodiment 92 that is cDNA.

94. A vector, comprising the nucleic acid molecule of any of embodiments 91-93.

95. The vector of embodiment 94 that is an expression vector.

96. The vector of embodiment 94 or embodiment 95, wherein the vector is a mammalian expression vector or a viral vector.

97. A cell, comprising the vector of any of embodiments 94-96.

98. The cell of embodiment 97 that is a mammalian cell.

99. The cell of embodiment 97 or embodiment 98 that is a human cell.

100. A method of producing a variant CD155 polypeptide or an immunomodulatory protein, comprising introducing the nucleic acid molecule of any of embodiments 91-93 or vector of any of embodiments 94-96 into a host cell under conditions to express the protein in the cell.

101. The method of embodiment 100, further comprising isolating or purifying the variant CD155 polypeptide or immunomodulatory protein from the cell.

102. A method of engineering a cell expressing a variant CD155 polypeptide, comprising introducing a nucleic acid molecule encoding the variant CD155 polypeptide of any of embodiments 1-49 or the immunomodulatory protein of any of embodiments 50-82 into a host cell under conditions in which the polypeptide is expressed in the cell.

103. An engineered cell, expressing the variant CD155 polypeptide of any of embodiments 1-49 an immunomodulatory protein of any of embodiments 50-82, the nucleic acid molecule of any of embodiments 79-81 or vector of any of embodiments 94-96.

104. The engineered cell of embodiment 103, wherein the variant CD155 polypeptide or immunomodulatory protein is encoded by a nucleic acid comprising a sequence of nucleotides encoding a signal peptide.

105. The engineered cell of embodiment 103 or embodiment 104, wherein the variant CD155 polypeptide or immunomodulatory protein does not comprise a transmembrane domain and/or is not expressed on the surface of the cell.

106. The engineered cell of any of embodiments 103-105, wherein the variant CD155 polypeptide or immunomodulatory protein is secreted from the engineered cell.

107. The engineered cell of embodiment 105 or embodiment 106, wherein the engineered cell comprises a variant CD155 polypeptide that comprises a transmembrane domain and/or is the transmembrane immunomodulatory protein of any of embodiments 43-49.

108. The engineered cell of any of embodiments 103, 104 and 107, wherein the variant CD155 polypeptide is expressed on the surface of the cell.

109. The engineered cell of any of embodiments 103-108, wherein the cell is an immune cell.

110. The engineered cell of embodiment 109, wherein the immune cell is an antigen presenting cell (APC) or a lymphocyte.

111. The engineered cell of any of embodiments 103-110 that is a primary cell.

112. The engineered cell of any of embodiments 103-111, wherein the cell is a mammalian cell.

113. The engineered cell of any of embodiments 103-112, wherein the cell is a human cell.

114. The engineered cell of any of embodiments 103-113, wherein the lymphocyte is a T cell.

115. The engineered cell of embodiment 110, wherein the APC is an artificial APC.

116. The engineered cell of any of embodiments 103-115, further comprising a chimeric antigen receptor (CAR) or an engineered T-cell receptor (TCR).

117. An infectious agent, comprising a nucleic acid molecule encoding a variant CD155 polypeptide of any of embodiments 1-49 or an immunomodulatory protein of any of embodiments 50-82.

118. The infectious agent of embodiment 117, wherein the encoded variant CD155 polypeptide or immunomodulatory protein does not comprise a transmembrane domain and/or is not expressed on the surface of a cell in which it is expressed.

119. The infectious agent of embodiment 117 or embodiment 118, wherein the encoded variant CD155 polypeptide or immunomodulatory protein is secreted from a cell in which it is expressed.

120. The infectious agent of embodiment 119, wherein the encoded variant CD155 polypeptide comprises a transmembrane domain.

121. The infectious agent of embodiment 119 or embodiment 120, wherein the encoded variant CD155 polypeptide is expressed on the surface of a cell in which it is expressed.

122. The infectious agent of any of embodiments 117-121, wherein the infectious agent is a bacterium or a virus.

123. The infectious agent of embodiment 122, wherein the infectious agent is a virus and the virus is an oncolytic virus.

124. The infectious agent of embodiment 123, wherein the oncolytic virus is an adenovirus, adeno-associated virus, herpes virus, Herpes Simplex Virus, Vesticular Stomatic virus, Reovirus, Newcastle Disease virus, parvovirus, measles virus, vesticular stomatitis virus (VSV), Coxsackie virus or a Vaccinia virus.

125. The infectious agent of embodiment 123, wherein the virus specifically targets dendritic cells (DCs) and/or is dendritic cell-tropic.

126. The infectious agent of embodiment 25, wherein the virus is a lentiviral vector that is pseudotyped with a modified Sindbis virus envelope product.

127. The infectious agent of any of embodiments 117-126, further comprising a nucleic acid molecule encoding a further gene product that results in death of a target cell or that can augment or boost an immune response.

128. The infectious agent of embodiment 127, wherein the further gene product is selected from an anticancer agent, an anti-metastatic agent, an antiangiogenic agent, an immunomodulatory molecule, an immune checkpoint inhibitor, an antibody, a cytokine, a growth factor, an antigen, a cytotoxic gene product, a pro-apoptotic gene product, an anti-apoptotic gene product, a cell matrix degradative gene, genes for tissue regeneration or reprogramming human somatic cells to pluripotency.

129. A pharmaceutical composition, comprising the variant CD155 polypeptide of any of embodiments 1-49, an immunomodulatory protein of any of embodiments 0-82, a conjugate of any of embodiments 83-90, an engineered cell of any of embodiments 103-116 or an infectious agent of any of embodiments 117-128.

130. The pharmaceutical composition of embodiment 129, comprising a pharmaceutically acceptable excipient.

131. The pharmaceutical composition of embodiment 129 or embodiment 130, wherein the pharmaceutical composition is sterile.

132. An article of manufacture comprising the pharmaceutical composition of any of embodiments 129-131 in a vial or container.

133. The article of manufacture of embodiment 132, wherein the vial or container is sealed.

134. A kit comprising the pharmaceutical composition of any of embodiments 129-131, and instructions for use.

135. A kit comprising the article of manufacture of embodiment 133 or embodiment 134, and instructions for use.

136. A method of modulating an immune response in a subject, comprising administering the pharmaceutical composition of any of embodiments 129-131 to the subject.

137. A method of modulating an immune response in a subject, comprising administering the engineered cells of any of embodiments 103-116.

138. The method of embodiment 137, wherein the engineered cells are autologous to the subject.

139. The method of embodiment 138, wherein the engineered cells are allogenic to the subject.

140. The method of any of embodiments 136-139, wherein modulating the immune response treats a disease or condition in the subject.

141. The method of any of embodiments 136-140, wherein the immune response is increased.

142. The method of any of embodiments 136, 140 and 141, wherein a variant CD155 polypeptide or immunomodulatory protein that is soluble is administered to the subject.

143. The method of embodiment 142, wherein the soluble immunomodulatory protein is an immunomodulatory Fc fusion protein.

144. The method of any of embodiments 136 and 140-143, wherein a variant CD155 polypeptide of any of embodiments 1-42 and 47-49, or the immunomodulatory protein of any of embodiments 50-82 is administered to the subject.

145. The method of any of embodiments 136-144, wherein an engineered cell comprising a secretable variant CD155 polypeptide is administered to the subject.

146. The method of any of embodiments 136-141 and 145, wherein an engineered cell of any of embodiments 103-106 and 109-116 is administered to the subject.

147. The method of any of embodiments 136, 140, and 141, wherein an infectious agent encoding a variant CD155 polypeptide that is a secretable immunomodulatory protein is administered to the subject, optionally under conditions in which the infectious agent infects a tumor cell or immune cell and the secretable immunomodulatory protein is secreted from the infected cell.

148. The method of any of embodiments 140-147, wherein the disease or condition is a tumor or cancer.

149. The method of any one of embodiments 140-148, wherein the disease or condition is selected from melanoma, lung cancer, bladder cancer, a hematological malignancy, liver cancer, brain cancer, renal cancer, breast cancer, pancreatic cancer, colorectal cancer, spleen cancer, prostate cancer, testicular cancer, ovarian cancer, uterine cancer, gastric carcinoma, a musculoskeletal cancer, a head and neck cancer, a gastrointestinal cancer, a germ cell cancer, or an endocrine and neuroendocrine cancer.

150. The method of any of embodiments 136-139, wherein the immune response is decreased.

151. The method of any of embodiments 136, 140 and 150, wherein an immunomodulatory protein or conjugate comprising a variant CD155 polypeptide linked to a moiety that localizes to a cell or tissue of an inflammatory environment is administered to the subject.

152. The method of embodiment 151, wherein the moiety comprises an antibody or an antigen-binding fragment thereof or comprises a second polypeptide comprising a wild-type IgSF domain or variant thereof.

153. The method of any of embodiments 136, 140 and 150-152, wherein the immunomodulatory protein of any of embodiments 57-59 or the conjugate of any of embodiments 83-90 is administered to the subject.

154. The method of any of embodiments 136-140 and 150, wherein a variant CD155 polypeptide that is a transmembrane immunomodulatory protein is administered to the subject.

155. The method of any of embodiments 136-140, 150, and 154, wherein the engineered cell comprising a variant CD155 polypeptide that is a transmembrane immunomodulatory protein of any of embodiments 43-49 is administered to the subject.

156. The method of any of embodiments 136, 140 and 150, wherein an infectious agent encoding a variant CD155 polypeptide that is a transmembrane immunomodulatory protein is administered to the subject, optionally under conditions in which the infectious agent infects a cell in the subject and the transmembrane immunomodulatory protein is expressed on the surface of the infected cell.

157. The method of any of embodiments 136, 140 and 150-156, wherein the disease or condition is an inflammatory or autoimmune disease or condition.

158. The method of any of embodiments 136-140 and 150-157, wherein the disease or condition is an anti-neutrophil cytoplasmic antibodies (ANCA)-associated vasculitis, a vasculitis, an autoimmune skin disease, transplantation, a Rheumatic disease, an inflammatory gastrointestinal disease, an inflammatory eye disease, an inflammatory neurological disease, an inflammatory pulmonary disease, an inflammatory endocrine disease, or an autoimmune hematological disease.

159. The method of any of embodiments 136-140 and 150-158, wherein the disease or condition is selected from inflammatory bowel disease, transplant, Crohn's disease, ulcerative colitis, multiple sclerosis, asthma, rheumatoid arthritis, or psoriasis.

142

IX. Examples

The following examples are included for illustrative purposes only and are not intended to limit the scope of the invention.

Example 1

Generation of Mutant DNA Constructs of IgSF Domains

Example 1 describes the generation of mutant DNA constructs of human CD155 IgSF domains for translation and expression on the surface of yeast as yeast display libraries.

A. Degenerate Libraries

Mutant DNA constructs encoding a variant of the IgV domain of CD155 were generated. Constructs were generated based on a wildtype human CD155 sequence set forth in SEQ ID NO:155 (containing the immunoglobulin-like V-type (IgV) domain as follows:

WPPPGTGDVVVQAPTQVPGFLGDSVTLPCYLQVPNMEVTHVSQLTWARHG

ESGSMAVFHQTQGPSYSESKRLEFVAARLGAELRNASLRMFGLRVEDEGN

YTCLFVTFPQGSRSVDIWLRVL

For libraries that target specific residues for complete or partial randomization with degenerate codons, the DNA encoding SEQ ID NO:155 were ordered from Integrated DNA Technologies (Coralville, IA) as a set of overlapping oligonucleotides of up to 80 base pairs (bp) in length. To generate a library of diverse variants of the IgV domain, the oligonucleotides contained desired degenerate codons, such as specific mixed base sets to code for various amino acid substitutions, at desired amino acid positions. Degenerate codons were generated using an algorithm at the URL: rosettadesign.med.unc.edu/SwiftLib/.

In general, positions to mutate and degenerate codons were chosen from crystal structure information (PDB: 3UDW) or homology models built from this structure containing the target-ligand pairs of interest to identify ligand contact residues, such as target side chain residues that interact with the ligand, as well as residues that are at the protein interaction interface. This analysis was performed using a structure viewer available at the URL: spdbv.vital-it.ch.

The next step in library design was the alignment of human, mouse, rat, and monkey CD155 sequences to identify conserved residues. Based on this analysis, conserved target residues were mutated with degenerate codons that only specified conservative amino acid changes plus the wild-type residue. Residues that were not conserved, were mutated more aggressively, but also included the wild-type residue. Degenerate codons that also encoded the wild-type residue were deployed to avoid excessive mutagenesis of target protein. For the same reason, only up to 20 positions were targeted for mutagenesis for each library. Mutational analysis was focused on contact and non-contact interfacial residues that were within 6 Å of the binding surface with their side chains directed toward the ligand/counter structure.

The oligonucleotides were dissolved in sterile water, mixed in equimolar ratios, heated to 95° C. for five minutes and slowly cooled to room temperature for annealing. IgV domain-specific oligonucleotide primers that anneal to the start and end of the IgV domain gene sequence were then used to generate PCR product. IgV domain-specific oligonucleotides which overlap by 40 bp with a modified version of pBYDS03 cloning vector (Life Technologies USA), beyond and including the BamHI and KpnI cloning sites, were then used to amplify 100 ng of PCR product from the prior step to generate a total of at least 12 μg of DNA for every electroporation. Both PCRs used OneTaq 2×PCR Master Mix (New England Biolabs, USA). The second PCR products were purified using a PCR purification kit (Qiagen, Germany) and resuspended in sterile deionized water. Alternatively, Ultramers (Integrated DNA Technologies) of up to 200 bp in length were used in conjunction with megaprimer PCR (URL: http://www.ncbi.nlm.nih.gov/pmc/articles/PMC146891/pdf/253371.pdf) to generate larger stretches of degenerate codons that could not be as easily incorporated using multiple small overlapping primers. Following the generation of full length product using megaprimer PCR, the mutant IgV domain library was PCR amplified again using DNA primers containing 40 bp overlap region with the modified pBYDSO3 cloning variant for homologous recombination into yeast.

To prepare for library insertion, the modified yeast display version of vector pBYDSO3 was digested with BamHI and KpnI restriction enzymes (New England Biolabs, USA) and the large vector fragment was gel-purified and dissolved in sterile, deionized water. Electroporation-ready DNA for the next step was generated by mixing 12 μg of library DNA insert with 4 μg of linearized vector in a total volume of 50 μL deionized and sterile water.

B. Random Libraries

Random libraries were also constructed to identify variants of the IgV domain of CD155 set forth in SEQ ID NO:155 containing the IgV domain. DNA encoding the wild-type IgV domain was cloned between the BamHI and KpnI restriction sites of the modified yeast display vector pBYDSO3. The DNA was then mutagenized with the Genemorph II Kit (Agilent, USA) to generate an average of three to five amino acid changes per library variant. Mutagenized DNA was then amplified by the two-step PCR and further processed as described above for targeted libraries.

Example 2

Introduction of DNA Libraries into Yeast

Example 2 describes the introduction of CD155 DNA libraries into yeast.

To introduce degenerate and random library DNA into yeast, electroporation-competent cells of yeast strain BJ5464 (ATCC.org; ATCC number 208288) were prepared and electroporated on a Gene Pulser II (Biorad, USA) with the electroporation-ready DNA from the steps above essentially as described (Colby, D. W. et al. 2004 Methods Enzymology 388, 348-358). The only exception is that transformed cells were grown in non-inducing minimal selective SCD-Leu medium to accommodate the LEU2 selectable marker carried by modified plasmid pBYDSO3. One liter of SCD-Leu media consists of 14.7 grams sodium citrate, 4.29 grams citric acid monohydrate, 20 grams dextrose, 6.7 grams yeast nitrogen base, and 1.6 grams yeast synthetic drop-out media supplement without leucine. The Medium was filter sterilized before use using a 0.22 μm vacuum filter device.

Library size was determined by plating serial dilutions of freshly recovered cells on SCD-Leu agar plates and then extrapolating library size from the number of single colonies from plating that generated at least 50 colonies per plate. In general, library sizes ranged from 10E8 to 10E9 transformants based on this dilution assay. The remainder of the electroporated culture was grown to saturation in SCD-Leu and cells from this culture were subcultured (e.g. 1/100) into fresh SCD-Leu once more to minimize the fraction of untransformed cells, and grown overnight. To maintain library diversity, this subculturing step was carried out using an inoculum that contained at least 10× more cells than the calculated library size. Cells from the second saturated culture were resuspended in fresh medium containing sterile 25% (weight/volume) glycerol to a density of 10E10/mL and frozen and stored at –80° C. (frozen library stock).

Example 3

Yeast Selection

Example 3 describes the selection of yeast expressing affinity modified variants of CD155.

A number of cells equal to at least 10 times the estimated library size were thawed from individual library stocks, suspended to 0.1×10E6 cells/mL in non-inducing SCD-Leu medium, and grown overnight. The next day, a number of cells equal to 10 times the library size were centrifuged at 2000 RPM for two minutes and resuspended to 0.5×10E6 cells/mL in inducing SCDG-Leu media. One liter of the SCDG-Leu induction media consists of 5.4 grams Na$_2$HPO$_4$, 8.56 grams of NaH$_2$PO$_4$·H$_2$O, 20 grams galactose, 2.0 grams dextrose, 6.7 grams yeast nitrogen base, and 1.6 grams of yeast synthetic drop out media supplement without leucine dissolved in water and sterilized through a 0.22 μm membrane filter device. The culture was grown in induction medium for 1 day at room temperature to induce expression of library proteins on the yeast cell surface.

Cells were sorted two to three times using magnetic beads loaded with cognate ligand to reduce non-binders and enrich for all variant CD155 with the ability to bind their exogenous recombinant counter-structure proteins. This was then followed by one to two rounds of fluorescence activated cell sorting (FACS) using exogenous counter-structure protein staining to enrich the fraction of yeast cells that displays improved binders. Magnetic bead enrichment and selections by flow cytometry were carried out essentially as described in Miller, K. D. Current Protocols in Cytometry 4.7.1-4.7.30, July 2008.

With CD155 libraries, target ligand proteins were employed as follows: human rTIGIT.Fc (i.e., recombinant TIGIT-Fc fusion protein) and rCD226.Fc was purchased from R & D Systems, USA. Magnetic Protein A beads were obtained from New England Biolabs, USA. For two-color, flow cytometric sorting, a Bio-Rad S3e sorter was used. CD155 display levels were monitored with an anti-hemagglutinin antibody labeled with Alexafluor 488 (Life Technologies, USA). Ligand binding of Fc fusion proteins, rTIGIT.Fc or rCD226.Fc, were detected with PE conjugated human Ig specific goat Fab (Jackson ImmunoResearch, USA). Doublet yeast were gated out using forward scatter (FSC)/side scatter (SSC) parameters, and sort gates were based upon higher ligand binding detected in FL2 that possessed more limited tag expression binding in FL1.

Yeast outputs from the flow cytometric sorts were assayed for higher specific binding affinity. Sort output yeast were expanded and re-induced to express the particular IgSF affinity modified domain variants they encode. This population then can be compared to the parental, wild-type yeast strain, or any other selected outputs, such as the bead output yeast population, by flow cytometry.

For CD155, the second FACS outputs (F2) were compared to parental CD155 yeast for binding rTIGIT.Fc or rCD226.Fc by double staining each population with anti-HA (hemagglutinin) tag expression and the anti-human Fc secondary to detect ligand binding.

Selected variant CD155 IgV domains were further formatted as fusion proteins and tested for binding and functional activity as described below.

Example 4

Reformatting Selection Outputs as Fc-Fusions and in Various Immunomodulatory Protein Types Example 4 describes reformatting of selection outputs identified in Example 3 as immunomodulatory proteins containing an affinity modified (variant) immunoglobulin-like V-type (IgV) domain of CD155 fused to an Fc molecule (variant IgV domain-Fc fusion molecules).

Output cells from final flow cytometric CD155 sorts were grown to terminal density in SCD-Leu medium. Plasmid DNA from each output was isolated using a yeast plasmid DNA isolation kit (Zymo Research, USA). For Fc fusions, PCR primers with added restriction sites suitable for cloning into the Fc fusion vector of choice were used to batch-amplify from the plasmid DNA preps the coding DNA for the mutant target IgV domains. After restriction digestion, the PCR products were ligated into an appropriate Fc fusion vector followed by heat shock transformation into *E. coli* strain XL1 Blue (Agilent, USA) or NEB5alpha (New England Biolabs) as directed by supplier. Alternatively, the outputs were PCR amplified with primers containing 40 bp overlap regions on either end with a modified Fc fusion vector to carry out in vitro recombination using Gibson Assembly Mastermix (New England Biolabs, USA), which was subsequently used for heat shock transformation into *E. coli* strain NEB5alpha. Exemplary of an Fc fusion vector is pFUSE-hIgG1-Fc2 (InvivoGen, USA).

Dilutions of transformation reactions were plated on LB-agar containing 100 μg/mL carbenicillin (Teknova, USA) to isolate single colonies for selection. Up to 96 colonies from each transformation were then grown in 96 well plates to saturation overnight at 37° C. in LB-broth (Teknova cat #L8112) and a small aliquot from each well was submitted for DNA sequencing of the IgV domain insert in order to identify mutation(s) in all clones. Sample preparation for DNA sequencing was carried out using protocols provided by the service provider (Genewiz; South Plainfield, NJ). After removal of sample for DNA sequencing, glycerol was then added to the remaining cultures for a final glycerol content of 25% and plates were stored at –20° C. for future use as master plates (see below). Alternatively, samples for DNA sequencing were generated by replica plating from grown liquid cultures onto solid agar plates using a disposable 96 well replicator (VWR, USA). These plates were incubated overnight to generate growth patches and the plates were submitted to Genewiz for DNA sequencing following their specifications.

After analysis of the Genewiz-generated DNA sequencing data, clones of interest were recovered from master plates and individually grown to saturation in 5 mL liquid LB-broth containing 100 μg/mL carbenicillin (Teknova, USA) and 2 mL of each culture were then used for preparation of approximately 10 μg of miniprep plasmid DNA of each clone using a standard kit such as the PureYield Plasmid Miniprep System (Promega, USA). Identification of clones of interest generally involved the following steps. First, DNA sequence data files were downloaded from the Genewiz website. All sequences were then manually curated so that they start at the beginning of the IgV domain coding region. The curated sequences were then batch-translated using a suitable program available at the URL: www.ebi-.ac.uk/Tools/st/emboss_transeq/. The translated sequences were then aligned using a suitable program available at the URL: multalin.toulouse.inra.fr/multalin/multalin.html. Alternatively, Genewiz sequences were processed to generate alignments using Ugene software (http://ugene.net).

Clones of interest were then identified using the following criteria: 1.) identical clone occurs at least two times in the alignment and 2.) a mutation occurs at least two times in the alignment and preferably in distinct clones. Clones that meet at least one of these criteria were enriched by the sorting process most likely due to improved binding.

To generate recombinant immunomodulatory proteins that are Fc fusion proteins containing an IgV domain of CD155 with at least one affinity-modified domain (e.g. variant CD155 IgV-Fc), the encoding DNA was generated to encode a protein as follows: variant (mutant) CD155 IgV domain followed by a linker of three alanines (AAA) followed by a human IgG1 Fc set forth in SEQ ID NO:1135 containing the mutations R292C, N297G and V302C by EU numbering (corresponding to R77C, N82G, and V87C with reference to wild-type human IgG1 Fc set forth in SEQ ID NO: 56). Since the construct does not include any antibody light chains that can form a covalent bond with a cysteine, the human IgG1 Fc also contains replacement of the cysteine residues to a serine residue at position 220 (C220S) by EU numbering (corresponding to position 5 (C5S) with reference to the wild-type or unmodified Fc set forth in SEQ ID NO: 56).

Example 5

Expression and Purification of Fc-Fusions

Example 5 describes the high throughput expression and purification of Fc-fusion proteins containing variant IgV CD155 as described in the above Examples.

Recombinant variant Fc fusion proteins were produced from suspension-adapted human embryonic kidney (HEK) 293 cells using the Expi293 expression system (Invitrogen, USA). 4 μg of each plasmid DNA from the previous step was added to 200 μL Opti-MEM (Invitrogen, USA) at the same time as 10.8 μL ExpiFectamine was separately added to another 200 μL Opti-MEM. After 5 minutes, the 200 μL of plasmid DNA was mixed with the 200 μL of ExpiFectamine and was further incubated for an additional 20 minutes before adding this mixture to cells. Ten million Expi293 cells were dispensed into separate wells of a sterile 10 ml, conical bottom, deep 24 well growth plate (Thomson Instrument Company, USA) in a volume 4 mL Expi293 media (Invitrogen, USA). Plates were shaken for 5 days at 120 RPM in a mammalian cell culture incubator set to 95% humidity and 8% $CO_2$. Following a 5 day incubation, cells were pelleted and culture supernatants were retained.

Proteins were purified from supernatants using a high throughput 96 well Protein A purification kit using the manufacturer's protocol (Catalog number 45202, Life Technologies, USA). Resulting elution fractions were buffer exchanged into PBS using Zeba 96 well spin desalting plate (Catalog number 89807, Life Technologies, USA) using the manufacturer's protocol. Purified protein was quantitated using 280 nm absorbance measured by Nanodrop instrument (Thermo Fisher Scientific, USA), and protein purity was assessed by loading 5 μg of protein on NUPAGE pre-cast, polyacrylamide gels (Life Technologies, USA) under denaturing and reducing conditions and subsequent gel electrophoresis. Proteins were visualized in gel using standard Coomassie staining.

Example 6

Assessment of Binding and Activity of Affinity-Matured IgSF Domain-Containing Molecules
A. Binding to Cell-Expressed Counter Structures This Example describes Fc-fusion binding studies of purified proteins from the above Examples to assess specificity and affinity of CD155 domain variant immunomodulatory proteins for cognate binding partners.

To produce cells expressing cognate binding partners, full-length mammalian surface expression constructs for each of human CD226, TIGIT and CD96 were designed in pcDNA3.1 expression vector (Life Technologies) and sourced from Genscript, USA. Binding studies were carried out on transfected HEK293 cells generated to express the full-length mammalian surface ligands using the transient transfection system (Life Technologies, USA) described above. As a control, binding to mock (non-transfected) cells also was assessed. The number of cells needed for the experiment was determined, and the appropriate 30 mL scale of transfection was performed using the manufacturer's suggested protocol. For each CD226, TIGIT, CD96 or mock 30 mL transfection, 75 million Expi293F cells were incubated with 30 μg expression construct DNA and 1.5 mL diluted ExpiFectamine 293 reagent for 48 hours, at which point cells were harvested for staining.

For staining by flow cytometry, 200,000 cells of appropriate transient transfection or negative control (mock) were plated in 96 well round bottom plates. Cells were spun down and resuspended in staining buffer (PBS (phosphate buffered saline), 1% BSA (bovine serum albumin), and 0.1% sodium azide) for 20 minutes to block non-specific binding. Afterwards, cells were centrifuged again and resuspended in staining buffer containing 100 nM to 1 nM variant CD155 Fc fusion protein in 50 μL. Primary staining was performed on ice for 45 minutes, before washing cells in staining buffer twice. PE-conjugated anti-human Fc (Jackson ImmunoResearch, USA) was diluted 1:150 in 50 μL staining buffer and added to cells and incubated another 30 minutes on ice. Secondary antibody was washed out twice, cells were fixed in 4% formaldehyde/PBS, and samples were analyzed on FACScan flow cytometer (Becton Dickinson, USA).

Mean Fluorescence Intensity (MFI) was calculated for each transfectant and negative parental line with Cell Quest Pro software (Becton Dickinson, USA). A ratio of the MFI value of the tested variant compared to the parental (WT) MFI value was also calculated. Exemplary results for binding to CD226, TIGIT, CD96 or mock cells is set forth in Table 10. Table 10 also indicates the amino acid substitutions in the IgV of the variant CD155 selected as described in the above Examples.
B. Bioactivity Characterization This Example further describes Fc-fusion variant protein bioactivity characterization in human primary T cell in vitro assays. Costimulatory bioactivity of CD155 fusion variants was determined in anti-CD3 coimmobilization assays. 1 nM or 4 nM mouse anti-human CD3 (OKT3, Biolegends, USA) was diluted in PBS with 1 nM to 80 nM rCD155.Fc variant proteins. This mixture was added to tissue culture treated flat bottom 96 well plates (Corning, USA) overnight to facilitate adherence of the stimulatory proteins to the wells of the plate. The next day, unbound protein was washed off the plates and 100,000 purified human pan T cells (BenTech Bio, US) or human T cell clone BC3 (Astarte Biologics, USA) were added to each well in a final volume of 200 μL of Ex-Vivo 15 media (Lonza, Switzerland). Cells were cultured 3 days before harvesting culture supernatants and measuring human IFN-gamma levels with Duoset ELISA kit (R&D Systems, USA).

Exemplary results from an anti-CD3 coimmobilization assay are set forth in Table 10 for selected exemplary variants.

Soluble rCD155.Fc bioactivity is also tested in a human Mixed Lymphocyte Reaction (MLR). Human primary dendritic cells (DC) are generated by culturing monocytes isolated from PBMC (BenTech Bio, USA) in vitro for 7 days with 500 U/mL rIL-4 (R&D Systems, USA) and 250 U/mL rGM-CSF (R&D Systems, USA) in Ex-Vivo 15 media (Lonza, Switzerland). 10,000 matured DC and 100,000 purified allogeneic CD4+ T cells (BenTech Bio, USA) are co-cultured with variant CD155 Fc fusion proteins and controls in 96 well round bottom plates in 200 μL final volume of Ex-Vivo 15 media. On day 5, IFN-gamma secretion in culture supernatants is analyzed using the Human IFN-gamma Duoset ELISA kit (R&D Systems, USA). Optical density is measured by VMax ELISA Microplate Reader (Molecular Devices, USA) and quantitated against titrated rIFN-gamma standard included in the IFN-gamma Duo-set kit (R&D Systems, USA).

TABLE 10

Variant CD155 selected against cognate binding partners. Molecule sequences, binding data, and costimulatory bioactivity data.

| CD155 mutations | SEQ ID NO (IgV) | CD226 tfxn MFI (CD226 MFI parental ratio) | TIGIT tfxn MFI (TIGIT MFI parental ratio) | CD96 MFI (CD96 MFI parental ratio) | Mock Expi293 MFI (Mock MFI parental ratio) | Anti-CD3 IFN-gamma (pg/ml) (Anti-CD3 IFN-gamma parental ratio) |
|---|---|---|---|---|---|---|
| P18S, P64S, F91S | 156 | 497825 (133.7) | 247219 (91.1) | 140065 (45.4) | 3528 (1.2) | 270.1 (0.7) |
| P18S, F91S, L104P | 157 | 26210 (7.0) | 75176 (27.7) | 10867 (3.5) | 2130 (0.7) | 364.2 (0.9) |
| L44P | 158 | 581289 (156.1) | 261931 (96.5) | 152252 (49.4) | 3414 (1.2) | 277.6 (0.7) |
| A56V | 159 | 455297 (122.3) | 280265 (103.2) | 161162 (52.2) | 2601 (0.9) | 548.2 (1.4) |
| P18L, L79V, F91S | 160 | 5135 (1.4) | 4073 (1.5) | 3279 (1.1) | 2719 (0.9) | 1241.5 (3.2) |
| P18S, F91S | 161 | 408623 (109.8) | 284190 (104.7) | 147463 (47.8) | 3348 (1.1) | 760.6 (2.0) |
| P18T, F91S | 162 | 401283 (107.8) | 223985 (82.5) | 157644 (51.1) | 3065 (1.1) | 814.7 (2.1) |
| P18T, S42P, F91S | 163 | 554105 (148.8) | 223887 (82.5) | 135395 (43.9) | 3796 (1.3) | 539.7 (1.4) |
| G7E, P18T, Y30C, F91S | 164 | 12903 (3.5) | 12984 (4.8) | 7906 (2.6) | 2671 (0.9) | 275.9 (0.7) |
| P18T, F91S, G111D | 165 | 438327 (117.7) | 287315 (105.8) | 167583 (54.3) | 4012 (1.4) | 307.2 (0.8) |
| P18S, F91P | 166 | 4154 (1.1) | 3220 (1.2) | 2678 (0.9) | 2816 (1.0) | 365.7 (0.9) |
| P18T, F91S, F108L | 167 | 394546 (106.0) | 298680 (110.0) | 193122 (62.6) | 2926 (1.0) | 775.4 (2.0) |
| P18T, T45A, F91S | 169 | 435847 (117.1) | 222044 (81.8) | 191026 (61.9) | 2948 (1.0) | 1546.8 (4.0) |
| P18T, F91S, R94H | 170 | 3589 (1.0) | 2942 (1.1) | 2509 (0.8) | 2390 (0.8) | 1273.2 (3.3) |
| P18S, Y30C, F91S | 171 | 382352 (102.7) | 276358 (101.8) | 56934 (18.5) | 3540 (1.2) | 426.5 (1.1) |
| A81V, L83P | 172 | 4169 (1.1) | 2912 (1.1) | 2616 (0.8) | 2993 (1.0) | 339.7 (0.9) |
| L88P | 173 | 65120 (17.5) | 74845 (27.6) | 35280 (11.4) | 2140 (0.7) | 969.2 (2.5) |
| Wild type | 174 | 3723 (1.0) | 2715 (1.0) | 3085 (1.0) | 2913 (1.0) | 389.6 (1.0) |
| R94H | 175 | 18905 (5.1) | 104013 (38.3) | 11727 (3.8) | 1663 (0.6) | 372.6 (1.0) |
| A13E, P18S, A56V, F91S | 175 | 357808 (96.1) | 179060 (66.0) | 118570 (38.4) | 2844 (1.0) | 349.2 (0.9) |
| P18T, F91S, V115A | 176 | 38487 (10.3) | 46313 (17.1) | 22718 (7.4) | 2070 (0.7) | 1574.5 (4.0) |
| P18T, Q60K | 177 | 238266 (64.0) | 173730 (64.0) | 154448 (50.1) | 4778 (1.6) | 427.2 (1.1) |

Example 7

Yeast Selection for Generation of Additional Variant Fc-Fusion Molecules

Example 7 describes the selection of yeast expressing affinity modified variants of CD155 and reformatting selected outputs as Fc fusion for the generation of additional Fc-fusion proteins containing IgV CD155 variants.

Following the affinity maturation selection described in Example 3, plasmid DNA with the target gene was extracted from the yeast cells using yeast miniprep, and the target gene was further mutated using the GeneMorph II Random Mutagenesis Kit. To lower the polymerase fidelity and therefore increase its error rate, several PCR reactions were setup with varying concentrations of MnCl2 from 0.0 to 1.0 mM. The resultant gene was amplified to achieve sufficient quantities for electroporation using OneTaq 2×PCR master mix. These gene products were electroporated into yeast cells, then grown and induced before an additional round of selection was performed.

The additional selection consisted of two positive selections with the desired counter structures TIGIT (FACS1 and FACS2) followed by one negative selection with the counter structure CD226 (FACS3) to select away from CD226 and improve binding specificity of the variant CD155. FACS selection were performed essentially as described in Example 3 above except the concentrations of the counter structures (TIGIT) and selection stringency of the positive sorts were varied to optimize lead identification. The concentration of CD226 for the negative selection was kept at 100 nM.

After selections were performed, outputs were plated onto SCD agar plates to isolate individual clones for analysis via flow cytometry or were subjected to yeast miniprep to extract plasmid DNA to use as template for mutagenesis for an additional round of selections as described above. To isolate individual yeast clones, colonies were picked from SCD agar plates and grown in starter cultures of 500 µL of SCD in deep 96 well plates (VWR, USA), for overnight growth at 300 Celsius and 300 rpm. The following day, the yeast cells were passaged into fresh SCD medium to an optical density ($OD_{600}$) of ~0.5, and were allowed to shake at 30° Celsius and 300 rpm for 5-6 hours until the $OD_{600}$ reached ~2.0. Cells then were collected by centrifugation and resuspended in SCDG medium at an $OD_{600}$ of ~1.0 for 16 induction at room temperature.

Following induction, cells were labeled with counter structures used in the positive (TIGIT) and negative (CD226) selections to identify leads containing the desired phenotype. The plasmid DNA from these leads was extracted using yeast miniprep, and the target gene was PCR amplified using OneTaq 2×PCR master mix and cloned into an Fc vector using Gibson Assembly Master Mix (New England Biolabs, USA). The intact plasmid DNA was transformed into chemically competent DH5a cells (New England Biolabs, USA, USA), which were plated on rectangular LB-agar plates containing carbenicillin in a 12×8 grid format to isolate single colonies for sequencing and selection. These plates were incubated overnight to generate growth patches and the plates were submitted to Genewiz for DNA sequencing of the IgV domain variant insert in order to identify the mutation(s) in all clones.

Identification of clones of interest generally involved the following steps. First, DNA sequence data files were downloaded from the Genewiz website. All sequences were then manually curated so that they started at the beginning of the IgV domain coding region. The curated sequences were then batch-translated using a suitable program available at the URL: www.ebi.ac.uk/Tools/st/emboss_transeq/. The translated sequences were then aligned using a suitable program available at the URL: multalin.toulouse.inra.fr/multalin/multalin.html.

Unique clones were transfected into HEK293 cells for expression and purification of recombinant human Fc tagged protein as described in Example 5. The additional Fc variants were formatted as Fc fusions as follows. For variants set forth in Tables 11A-11C, the selected variant IgV domains were generated as Fc-fusion proteins containing: variant (mutant) IgV domain followed by a linker of three alanines (AAA) followed by a human IgG1 Fc containing the mutations C220S, R292C, N297G and V302C (SEQ ID NO:1135). For variants set forth in Tables 11D and 11E, the selected variant IgV domains were generated as Fc-fusion proteins containing: variant (mutant) IgV domain followed by a GSGGGGS linker followed by a human IgG1 Fc containing the mutations L234A, L235E, G237A, E356D and M358L by EU numbering (SEQ ID NO:1119).

Example 8

Assessment of Binding to Cell-Expressed Counter Structures

This Example describes Fc-fusion binding studies of purified variant IgV Fc fusion proteins identified and generated in Example 7 to assess specificity and affinity of additional CD155 domain variant immunomodulatory proteins for cognate binding partners.

HEK293 cells expressing the full-length mammalian surface expression constructs for human TIGIT, CD226 or CD96 were generated and binding was assessed as described in Example 6. In this experiment, HEK293 cells also were transfected with CD112R. Mean Fluorescence Intensity (MFI) value for binding of 100 nM of each variant Fc-fusion molecule was calculated and compared to the binding of the corresponding unmodified (wildtype) ECD-Fc fusion molecule not containing the amino acid substitution(s). Tables 11A-11B sets forth the binding results for exemplary variant Fc-fusion molecules and also indicates amino acid substitutions in the IgV of the variant CD155 selected as described in Example 7. Binding to wildtype CD155 IgV-Fc molecule and an antibody targeting human Fc (anti-hFc PE) were also tested as controls.

As shown in Tables 11 Å and 111B, the selections resulted in the identification of additional variant CD155 IgV-Fc fusion molecules that exhibited altered binding to at least one cognate binding partner.

TABLE 11A

Additional CD155 Variants and Binding Data.

| CD155 Mutation(s) | SEQ ID NO (IgV) | TIGIT | | CD226 | | CD112R | | CD96 | |
|---|---|---|---|---|---|---|---|---|---|
| | | MFI at 100 nM | Fold ↑ to WT ECD | MFI at 100 nM | Fold ↑ to WT ECD | MFI at 100 nM | Fold ↑ to WT ECD | MFI at 100 nM | Fold ↑ to WT ECD |
| S52M | 372 | 1865.3 | 0.00 | 1901.0 | 0.01 | 1553.4 | 0.87 | 1609.8 | 0.02 |
| T45Q, S52L, L104E, G111R | 373 | 2287.0 | 0.01 | 2390.4 | 0.01 | 1735.1 | 0.97 | 1575.1 | 0.02 |
| S42G | 374 | 4837.5 | 0.01 | 2448.1 | 0.01 | 1815.4 | 1.02 | 1699.6 | 0.02 |
| Q62F | 375 | 2209.5 | 0.01 | 2572.1 | 0.01 | 2706.5 | 1.52 | 2760.7 | 0.03 |
| S52Q | 376 | 2288.1 | 0.01 | 2022.3 | 0.01 | 1790.1 | 1.00 | 1822.3 | 0.02 |
| S42A, L104Q, G111R | 377 | 1923.7 | 0.00 | 1901.7 | 0.01 | 1815.1 | 1.02 | 1703.8 | 0.02 |
| S42A, S52Q, L104Q, G111R | 378 | 1807.5 | 0.00 | 2157.2 | 0.01 | 1894.4 | 1.06 | 1644.0 | 0.02 |
| S52W, L104E | 379 | 1938.2 | 0.00 | 1905.6 | 0.01 | 2070.6 | 1.16 | 1629.5 | 0.02 |
| S42C | 380 | 1914.0 | 0.00 | 2096.1 | 0.01 | 1685.0 | 0.95 | 1592.4 | 0.02 |
| S52W | 381 | 1991.6 | 0.00 | 2037.3 | 0.01 | 1612.8 | 0.90 | 1712.9 | 0.02 |
| S52M, L104Q | 382 | 2666.6 | 0.01 | 2252.2 | 0.01 | 1706.0 | 0.96 | 1633.1 | 0.02 |
| S42L, S52L, Q62F, L104Q | 383 | 2021.4 | 0.00 | 2643.8 | 0.02 | 1730.1 | 0.97 | 2318.7 | 0.02 |
| S42W | 384 | 2434.5 | 0.01 | 2133.4 | 0.01 | 2325.7 | 1.30 | 2555.4 | 0.03 |
| S42Q | 385 | 2073.5 | 0.00 | 2225.9 | 0.01 | 1905.1 | 1.07 | 2143.1 | 0.02 |
| S52L | 386 | 2224.8 | 0.01 | 2676.3 | 0.02 | 2038.6 | 1.14 | 2043.2 | 0.02 |

TABLE 11A-continued

Additional CD155 Variants and Binding Data.

| CD155 Mutation(s) | SEQ ID NO (IgV) | TIGIT | | CD226 | | CD112R | | CD96 | |
|---|---|---|---|---|---|---|---|---|---|
| | | MFI at 100 nM | Fold ↑ to WT ECD | MFI at 100 nM | Fold ↑ to WT ECD | MFI at 100 nM | Fold ↑ to WT ECD | MFI at 100 nM | Fold ↑ to WT ECD |
| S52R | 387 | 4395.4 | 0.01 | 3964.4 | 0.02 | 2741.7 | 1.54 | 4846.9 | 0.05 |
| L104E | 388 | 3135.4 | 0.01 | 2264.2 | 0.01 | 1803.5 | 1.01 | 1556.7 | 0.02 |
| G111R | 389 | 2082.7 | 0.00 | 2791.3 | 0.02 | 2470.9 | 1.39 | 3317.1 | 0.03 |
| S52E | 390 | 2655.4 | 0.01 | 2599.8 | 0.02 | 1904.9 | 1.07 | 1799.0 | 0.02 |
| Q62Y | 391 | 2528.6 | 0.01 | 2621.4 | 0.02 | 1918.4 | 1.08 | 1827.5 | 0.02 |
| T45Q, S52M, L104E | 392 | 79498.2 | 0.19 | 143238.5 | 0.83 | 2600.6 | 1.46 | 6310.4 | 0.06 |
| S42N, L104Q, G111R | 393 | 2432.1 | 0.01 | 2311.3 | 0.01 | 1847.4 | 1.04 | 1958.3 | 0.02 |
| S52M, V57L | 394 | 1760.7 | 0.00 | 2431.6 | 0.01 | 2006.9 | 1.13 | 1858.7 | 0.02 |
| S42N, S52Q, Q62F | 395 | 2402.7 | 0.01 | 2152.0 | 0.01 | 1855.0 | 1.04 | 1737.6 | 0.02 |
| S42A, S52L, L104E, G111R | 396 | 2262.7 | 0.01 | 1889.4 | 0.01 | 1783.2 | 1.00 | 1606.2 | 0.02 |
| S42W, S52Q, V57L, Q62Y | 397 | 1961.4 | 0.00 | 2138.3 | 0.01 | 1844.9 | 1.03 | 1699.6 | 0.02 |
| L104Q | 398 | 10314.4 | 0.02 | 3791.4 | 0.02 | 2119.9 | 1.19 | 1542.6 | 0.02 |
| S42L, S52Q, L104E | 399 | 1946.9 | 0.00 | 6474.3 | 0.04 | 1749.0 | 0.98 | 1702.2 | 0.02 |
| S42C, S52L | 400 | 1762.5 | 0.00 | 2147.3 | 0.01 | 1663.4 | 0.93 | 1484.7 | 0.01 |
| S42W, S52R, Q62Y, L104Q | 401 | 1918.8 | 0.00 | 2300.1 | 0.01 | 1824.6 | 1.02 | 1756.0 | 0.02 |
| T45Q, S52R, L104E | 402 | 121636.9 | 0.29 | 142381.2 | 0.82 | 2617.9 | 1.47 | 3748.2 | 0.04 |
| S52R, Q62F, L104Q, G111R | 403 | 2969.2 | 0.01 | 3171.6 | 0.02 | 1725.4 | 0.97 | 2362.3 | 0.02 |
| T45Q, S52L, V57L, L104E | 404 | 2857.7 | 0.01 | 5943.5 | 0.03 | 1496.8 | 0.84 | 1533.3 | 0.02 |
| S52M, Q62Y | 405 | 1926.6 | 0.00 | 2000.3 | 0.01 | 1771.6 | 0.99 | 1651.1 | 0.02 |
| Q62F, L104E, G111R | 406 | 1966.4 | 0.00 | 2043.5 | 0.01 | 1701.9 | 0.95 | 1524.8 | 0.02 |
| T45Q, S52Q | 407 | 4812.8 | 0.01 | 5787.5 | 0.03 | 1765.6 | 0.99 | 2451.3 | 0.02 |
| S52L, L104E | 408 | 4317.8 | 0.01 | 2213.9 | 0.01 | 1756.9 | 0.99 | 1829.3 | 0.02 |
| S42V, S52E | 409 | 2055.0 | 0.00 | 2272.6 | 0.01 | 1808.0 | 1.01 | 2530.2 | 0.03 |
| T45Q, S52R, G111R | 410 | 4092.3 | 0.01 | 2075.2 | 0.01 | 1793.6 | 1.01 | 2336.6 | 0.02 |
| S42G, S52Q, L104E, G111R | 411 | 2010.1 | 0.00 | 2019.2 | 0.01 | 1706.4 | 0.96 | 1707.6 | 0.02 |
| S42N, S52E, V57L, L104E | 412 | 1784.2 | 0.00 | 1743.6 | 0.01 | 1690.1 | 0.95 | 1538.7 | 0.02 |
| Wildtype | 155 | 1964.7 | 0.00 | 2317.1 | 0.01 | 2169.6 | 1.22 | 1893.4 | 0.02 |
| S42C, S52M, Q62F | 413 | 1861.0 | 0.00 | 2084.2 | 0.01 | 1592.3 | 0.89 | 1481.3 | 0.01 |
| S42L | 414 | 1930.4 | 0.00 | 2187.2 | 0.01 | 1743.2 | 0.98 | 1618.4 | 0.02 |
| Wildtype | 155 | 2182.6 | 0.01 | 2374.5 | 0.01 | 1743.1 | 0.98 | 1680.4 | 0.02 |
| S42A | 415 | 1929.2 | 0.00 | 2188.6 | 0.01 | 1733.7 | 0.97 | 1623.6 | 0.02 |
| S42G, S52L, Q62F, L104Q | 416 | 1924.3 | 0.00 | 2157.6 | 0.01 | 1661.3 | 0.93 | 1642.1 | 0.02 |
| S42N | 417 | 1817.4 | 0.00 | 1910.9 | 0.01 | 1699.7 | 0.95 | 1691.5 | 0.02 |
| CD155 IgV Fc | H1020 | 4690 | 0.01 | 4690 | 0.03 | 2941 | 1.65 | 3272 | 0.03 |
| Wildtype CD155 ECD-Fc | 47 (ECD) | 423797 | 1.00 | 172839 | 1.00 | 1783 | 1.00 | 99037 | 1.00 |
| Anti-human Fc PE | — | 1506.3 | 0.00 | 3774 | 0.02 | 1587 | 0.89 | 1618 | 0.02 |

TABLE 11B

Additional CD155 Variants and Binding Data.

| CD155 Mutation(s) | SEQ ID NO (IgV) | TIGIT | | CD226 | | CD96 | |
|---|---|---|---|---|---|---|---|
| | | MFI at 100 nM | Fold Increase to WT ECD | MFI at 100 nM | Fold Increase to WT ECD | MFI at 100 nM | Fold Increase to WT ECD |
| P18T, S65A, S67V, F91S | 418 | 297843 | 1.99 | 351195 | 3.22 | 128180 | 1.68 |
| P18F, T39A, T45Q, T61R, S65N, S67L, E73G, R78G | 419 | Little to no protein produced | | | | | |
| P18T, T45Q, T61R, S65N, S67L | 420 | 224682 | 1.50 | 270175 | 2.48 | 22820 | 0.30 |
| P18F, S65A, S67V, F91S | 421 | 534106 | 3.57 | 350410 | 3.21 | 144069 | 1.89 |
| P18F, T45Q, T61R, S65N, S67L, F91S, L104P | 422 | Little to no protein produced | | | | | |
| P18S, L79P, L104M | 423 | 342549 | 2.29 | 320823 | 2.94 | 107532 | 1.41 |
| P18S, L104M | 424 | 449066 | 3.00 | 295126 | 2.70 | 121266 | 1.59 |
| L79P, L104M | 425 | 3210 | 0.02 | 8323 | 0.08 | 2894 | 0.04 |
| P18T, T45Q, L79P | 426 | 542878 | 3.63 | 371498 | 3.40 | 193719 | 2.55 |

TABLE 11B-continued

Additional CD155 Variants and Binding Data.

| CD155 Mutation(s) | SEQ ID NO (IgV) | TIGIT | | CD226 | | CD96 | |
|---|---|---|---|---|---|---|---|
| | | MFI at 100 nM | Fold Increase to WT ECD | MFI at 100 nM | Fold Increase to WT ECD | MFI at 100 nM | Fold Increase to WT ECD |
| P18T, T45Q, T61R, S65H, S67H | 427 | 312337 | 2.09 | 225439 | 2.07 | 152903 | 2.01 |
| P18T, A81E | 428 | | | Little to no protein produced | | | |
| P18S, D23Y, E37P, S52G, Q62M, G80S, A81P, G99Y, S112N | 429 | | | Little to no protein produced | | | |
| A13R, D23Y, E37P, S42P, Q62Y, A81E | 430 | 4161 | 0.03 | 11673 | 0.11 | 5762 | 0.08 |
| A13R, D23Y, E37P, G99Y, S112N | 431 | | | Little to no protein produced | | | |
| A13R, D23Y, E37P, Q62M, A77V, G80S, A81P, G99Y | 432 | | | Little to no protein produced | | | |
| P18L, E37S, Q62M, G80S, A81P, G99Y, S112N | 433 | 5900 | 0.04 | 14642 | 0.13 | 3345 | 0.04 |
| P18S, L104T | 434 | 321741 | 2.15 | 367470 | 3.37 | 108569 | 1.43 |
| P18S, Q62H, L79Q, F91S | 435 | 283357 | 1.89 | 324877 | 2.98 | 125541 | 1.65 |
| P18S, F91S | 161 | 222780 | 1.49 | 300049 | 2.75 | 48542 | 0.64 |
| T45Q, S52K, Q62F, L104Q, G111R | 436 | | | Little to no protein produced | | | |
| T45Q, S52Q, Q62Y, L104Q, G111R | 437 | | | Little to no protein produced | | | |
| T45Q, S52Q, Q62Y, L104E, G111R | 438 | | | Little to no protein produced | | | |
| V57A, T61M, S65W, S67A, E96D, L104T | 439 | | | Little to no protein produced | | | |
| P18L, V57T, T61S, S65Y, S67A, L104T | 440 | 278178 | 1.86 | 276870 | 2.54 | 121499 | 1.60 |
| P18T, T45Q | 441 | 326769 | 2.18 | 357515 | 3.28 | 92389 | 1.21 |
| P18L, V57A, T61M, S65W, S67A, L104T | 442 | | | Little to no protein produced | | | |
| T61M, S65W, S67A, L104T | 443 | 360915 | 2.41 | 417897 | 3.83 | 148954 | 1.96 |
| P18S, V41A, S42G, T45G, L104N | 444 | 3821 | 0.03 | 11449 | 0.10 | 3087 | 0.04 |
| P18H, S42G, T45I, S52T, G53R, S54H, V57L, H59E, T61S, S65D, E68G, L104N | 445 | 5066 | 0.03 | 177351 | 1.63 | 3700 | 0.05 |
| P18S, S42G, T45V, F58L, S67W, L104N | 446 | 14137 | 0.09 | 15175 | 0.14 | 15324 | 0.20 |
| P18S, T45I, L104N | 447 | 141745 | 0.95 | 298011 | 2.73 | 97246 | 1.28 |
| P18S, S42G, T45G, L104N, V106A | 448 | 29387 | 0.20 | 117965 | 1.08 | 15884 | 0.21 |
| P18H, H40R, S42G, T45I, S52T, G53R, S54H, V57L, H59E, T61S, S65D, E68G, L104Y, V106L, F108H | 449 | 12335 | 0.08 | 14657 | 0.13 | 15779 | 0.21 |
| E37V, S42G, T45G, L104N | 450 | | | Little to no protein produced | | | |
| P18S, T45Q, L79P, L104T | 451 | 206674 | 1.38 | 285512 | 2.62 | 87790 | 1.15 |
| P18L, Q62R | 452 | 66939 | 0.45 | 25063 | 0.23 | 10928 | 0.14 |
| A13R, D23Y, E37P, S42L, S52G, Q62Y, A81E | 453 | | | Little to no protein produced | | | |
| P18L, H49R, L104T, D116N | 454 | 167980 | 1.12 | 214677 | 1.97 | 62451 | 0.82 |
| A13R, D23Y, E37P, Q62M, G80S, A81P, L104T | 455 | | | Little to no protein produced | | | |
| S65T, L104T | 456 | 205942 | 1.38 | 187147 | 1.71 | 65207 | 0.86 |
| A13R, D23Y, E37P, S52G, V57A, Q62M, K70E, L104T | 457 | | | Little to no protein produced | | | |
| P18L, A47V, Q62Y, E73D, L104T | 458 | 146142 | 0.98 | 248926 | 2.28 | 73956 | 0.97 |
| H40T, V41M, A47V, S52Q, Q62L, S65T, E73R, D97G, E98S, L104T, D116N | 459 | | | Little to no protein produced | | | |
| P18L, S42P, T45Q, T61G, S65H, S67E, L104T, D116N | 460 | 153536 | 1.03 | 402503 | 3.69 | 53044 | 0.70 |
| P18S, H40T, V41M, A47V, S52Q, Q62L, S65T, E73R, L104M, V106A | 461 | | | Little to no protein produced | | | |
| H40T, V41M, A47V, S52Q, Q62L, S65T, E68G, E73R, D97G, E98S, L104T | 462 | | | Little to no protein produced | | | |
| T45Q, S52E, L104E | 463 | | | Little to no protein produced | | | |
| T45Q, S52E, Q62F, L104E | 464 | 132850 | 0.89 | 276434 | 2.53 | 14558 | 0.19 |
| Wildtype CD155 ECD-Fc | 47 (ECD) | 149692 | 1.00 | 109137 | 1.00 | 76083 | 1.00 |
| Anti-human Fc PE | — | 2287 | 0.02 | 4799 | 0.04 | 2061 | 0.03 |

Mean Fluorescence Intensity (MFI) was calculated for cognate binding partners TIGIT and CD226 for additional selected variant CD155 IgV-Fc fusion molecules in two separate experiments. A ratio of the TIGIT MFI value compared to the CD226 MIFI value was also calculated. Tables 11C-11E set forth the binding results for exemplary variant Fc-fusion molecules and also indicate amino acid substitutions in the IgV of the variant CD155 selected as described in Example 7. As shown in Table 10C-10E, the indicated variant CD155 IgV-Fc fusion molecules exhibited increased binding specifically for TIGIT but not CD226.

TABLE 11C

| Additional CD155 Variants and Binding Data. | | | | | | | |
| --- | --- | --- | --- | --- | --- | --- | --- |
| | | TIGIT | | CD226 | | CD96 | |
| CD155 Mutations | SEQ ID NO (IgV) | MFI at 100 nM | Fold Increase to WT IgV | MFI at 100 nM | Fold Increase to WT IgV | MFI at 100 nM | Fold Increase to WT IgV |
| P18F, T26M, L44V, Q62K, L79P, F91S, L104M, G111D | 465 | 117327 | 1.2 | 1613 | 0.1 | 1629 | 0.1 |
| P18S, T45S, T61K, S65W, S67A, F91S, G111R | 466 | 124936 | 1.3 | 2114 | 0.1 | 2223 | 0.1 |
| P18S, L79P, L104M, T107M | 467 | 110512 | 1.1 | 18337 | 0.9 | 22793 | 1.3 |
| P18S, S65W, S67A, M90V, V95A, L104Q, G111R | 468 | 101726 | 1.0 | 1605 | 0.1 | 2571 | 0.1 |
| Wildtype CD155-ECD | 47 (ECD) | 98935 | 1.0 | 20029 | 1.0 | 17410 | 1.0 |

TABLE 11D

| Additional CD155 Variants and Binding Data. | | | | | | | |
| --- | --- | --- | --- | --- | --- | --- | --- |
| | | TIGIT | | CD226 | | CD96 | |
| CD155 Mutations | SEQ ID NO (IgV) | MFI at 11.1 nM | Fold Change from CD155-ECD | MFI at 11.1 nM | Fold Change from CD155-ECD | MFI at 11.1 nM | Fold Change from CD155-ECD |
| P18S, A47G, L79P, F91S, L104M, T107A, R113W | 1207 | 56,409 | 1.19 | 1,191 | 0.08 | 25,362 | 1.49 |
| P18T, D23G, S24A, N35D, H49L, L79P, F91S, L104M, G111R | 1208 | 128,536 | 2.72 | 987 | 0.06 | 3,497 | 0.20 |
| V9L, P18S, Q60R, V75L, L79P, R89K, F91S, L104E, G111R | 1209 | 125,329 | 2.65 | 986 | 0.06 | 959 | 0.06 |
| P18S, H49R, E73D, L79P, N85D, F91S, V95A, L104M, G111R | 1210 | Little to no protein produced | | | | | |
| V11A, P18S, L79P, F91S, L104M, G111R | 1211 | 48,246 | 1.02 | 974 | 0.06 | 923 | 0.05 |
| V11A, P18S, S54R, Q60P, Q62K, L79P, N85D, F91S, T107M | 1212 | 190,392 | 4.02 | 1,019 | 0.07 | 1,129 | 0.07 |
| P18T, S52P, S65A, S67V, L79P, F91S, L104M, G111R | 1213 | 121,611 | 2.57 | 986 | 0.06 | 16,507 | 0.97 |
| P18T, M36T, L79P, F91S, G111R | 1214 | 150,015 | 3.17 | 1,029 | 0.07 | 2,514 | 0.15 |
| D8G, P18S, M36I, V38A, H49Q, A76E, F91S, L104M, T107A, R113W | 1215 | 79,333 | 1.68 | 1,026 | 0.07 | 2,313 | 0.14 |
| P18S, S52P, S65A, S67V, L79P, F91S, L104M, T107S, R113W | 1216 | 23,766 | 0.50 | 1,004 | 0.07 | 1,080 | 0.06 |
| T15I, P18T, L79P, F91S, L104M, G111R | 1217 | 55,498 | 1.17 | 1,516 | 0.10 | 1,030 | 0.06 |
| P18F, T26M, L44V, Q62K, L79P, E82D, F91S, L104M, G111D | 1218 | 213,640 | 4.51 | 991 | 0.06 | 1,276 | 0.07 |
| P18T, E37G, G53R, Q62K, L79P, F91S, E98D, L104M, T107M | 1219 | 251,288 | 5.31 | 2,001 | 0.13 | 45,878 | 2.69 |
| P18L, K70E, L79P, F91S, V95A, G111R | 1220 | 62,608 | 1.32 | 1,117 | 0.07 | 973 | 0.06 |
| V9I, Q12K, P18F, S65A, S67V, L79P, L104T, G111R, S112I | 1221 | 81,932 | 1.73 | 803 | 0.05 | 68,295 | 4.00 |
| P18F, S65A, S67V, F91S, L104M, G111R | 1222 | 30,661 | 0.65 | 901 | 0.06 | 3,193 | 0.19 |
| V9I, V10I, P18S, F20S, T45A, L79P, F91S, L104M, F108Y, G111R, S112V | 1223 | 151,489 | 3.20 | 973 | 0.06 | 974 | 0.06 |
| V9L, P18L, L79P, M90I, F91S, T102S, L104M, G111R | 1224 | 155,279 | 3.28 | 910 | 0.06 | 10,568 | 0.62 |
| P18C, T26M, L44V, M55I, Q62K, L79P, F91S, L104M, T107M | 1225 | 137,521 | 2.91 | 973 | 0.06 | 111,085 | 6.51 |

TABLE 11D-continued

Additional CD155 Variants and Binding Data.

| CD155 Mutations | SEQ ID NO (IgV) | TIGIT | | CD226 | | CD96 | |
|---|---|---|---|---|---|---|---|
| | | MFI at 11.1 nM | Fold Change from CD155-ECD | MFI at 11.1 nM | Fold Change from CD155-ECD | MFI at 11.1 nM | Fold Change from CD155-ECD |
| V9I, P18T, D23G, L79P, F91S, G111R | 1226 | 151,426 | 3.20 | 897 | 0.06 | 2,725 | 0.16 |
| P18F, L79P, M90L, F91S, V95A, L104M, G111R | 1227 | 125,639 | 2.66 | 917 | 0.06 | 3,939 | 0.23 |
| P18F, L79P, M90L, F91S, V95A, L104M, G111R | 1227 | 115,156 | 2.43 | 1,073 | 0.07 | 2,464 | 0.14 |
| P18T, M36T, S65A, S67E, L79Q, A81T, F91S, G111R | 1228 | 10,616 | 0.22 | 1,130 | 0.07 | 963 | 0.06 |
| V9L, P18T, Q62R, L79P, F91S, L104M, G111R | 1229 | 195,111 | 4.12 | 835 | 0.05 | 1,497 | 0.09 |
| CD155-ECD-Fc | — | 47,319 | 1.00 | 15,421 | 1.00 | 17,067 | 1.00 |
| Fc Control | — | 2,298 | 0.05 | 1,133 | 0.07 | 996 | 0.06 |

TABLE 11E

Additional CD155 Variants and Binding Data.

| CD155 Mutations | SEQ ID NO (IgV) | TIGIT | | CD226 | | CD112R | | CD96 | |
|---|---|---|---|---|---|---|---|---|---|
| | | MFI at 25 nM | Fold Change from CD155-ECD | MFI at 25 nM | Fold Change from CD155-ECD | MFI at 25 nM | Fold Change from CD155-ECD | MFI at 25 nM | Fold Change from CD155-ECD |
| P18T, G19D, M36T, S54N, L79P, L83Q, F91S, T107M, F108Y | 1702 | 905 | 0.02 | 748 | 0.02 | 1276 | 1.56 | 726 | 0.01 |
| V9L, P18L, M55V, S69L, L79P, A81E, F91S, T107M | 1703 | 58656 | 1.34 | 11166 | 0.29 | 920 | 1.13 | 67364 | 1.39 |
| P18F, H40Q, T61K, Q62K, L79P, F91S, L104M, T107V | 1704 | 108441 | 2.48 | 853 | 0.02 | 918 | 1.13 | 8035 | 0.17 |
| P18S, Q32R, Q62K, R78G, L79P, F91S, T107A, R113W | 1705 | 5772 | 0.13 | 701 | 0.02 | 843 | 1.03 | 831 | 0.02 |
| Q12H, P18T, L21S, G22S, V57A, Q62R, L79P, F91S, T107M | 1706 | 1084 | 0.02 | 687 | 0.02 | 876 | 1.07 | 818 | 0.02 |
| V9I, P18S, S24P, H49Q, F58Y, Q60R, Q62K, L79P, F91S, T107M | 1707 | 69926 | 1.60 | 1089 | 0.03 | 1026 | 1.26 | 43856 | 0.90 |
| P18T, W46C, H49R, S65A, S67V, A76T, L79P, S87T, L104M | 1708 | 918 | 0.02 | 640 | 0.02 | 803 | 0.98 | 717 | 0.01 |
| P18S, S42T, E51G, L79P, F91S, G92W, T107M | 1709 | 12630 | 0.29 | 707 | 0.02 | 857 | 1.05 | 1050 | 0.02 |
| P18S, S42T, E51G, L79P, F91S, G92W, T107M | 1709 | 7476 | 0.17 | 851 | 0.02 | 935 | 1.15 | 924 | 0.02 |
| V10F, T15S, P18L, R48Q, L79P, F91S, T107M, V115M | 1710 | 1168 | 0.03 | 792 | 0.02 | 901 | 1.10 | 998 | 0.02 |
| P18S, L21M, Y30F, N35D, R84W, F91S, T107M, D116G | 1711 | 1377 | 0.03 | 743 | 0.02 | 946 | 1.16 | 1033 | 0.02 |
| P18F, E51V, S54G, Q60R, L79Q, E82G, S87T, M90I, F91S, G92R, T107M | 1712 | 46090 | 1.05 | 15701 | 0.41 | 1012 | 1.24 | 61814 | 1.27 |
| Q16H, P18F, F91S, T107M | 1713 | | | Little to no protein produced | | | | | |
| P18T, D23G, Q60R, S67L, L79P, F91S, T107M, V115A | 1714 | 64091 | 1.47 | 30931 | 0.81 | 874 | 1.07 | 108875 | 2.24 |
| D8G, V9I, V11A, P18T, T26M, S52P, L79P, F91S, G92A, T107L, V115A | 1715 | 52508 | 1.20 | 9483 | 0.25 | 817 | 1.00 | 97770 | 2.01 |
| V9I, P18F, A47E, G50S, E68G, L79P, F91S, T107M | 1716 | 55167 | 1.26 | 54341 | 1.43 | 752 | 0.92 | 102115 | 2.10 |
| P18S, M55I, Q62K, S69P, L79P, F91S, T107M | 1717 | | | Little to no protein produced | | | | | |
| P18T, T39S, S52P, S54R, L79P, F91S, T107M | 1718 | 45927 | 1.05 | 744 | 0.02 | 1038 | 1.27 | 1225 | 0.03 |
| P18S, D23N, L79P, F91S, T107M, S114N | 1719 | | | Little to no protein produced | | | | | |
| P18S, P34S, E51V, L79P, F91S, G111R | 1720 | 7917 | 0.18 | 769 | 0.02 | 853 | 1.04 | 892 | 0.02 |

TABLE 11E-continued

Additional CD155 Variants and Binding Data.

| | | TIGIT | | CD226 | | CD112R | | CD96 | |
|---|---|---|---|---|---|---|---|---|---|
| CD155 Mutations | SEQ ID NO (IgV) | MFI at 25 nM | Fold Change from CD155-ECD | MFI at 25 nM | Fold Change from CD155-ECD | MFI at 25 nM | Fold Change from CD155-ECD | MFI at 25 nM | Fold Change from CD155-ECD |
| P18S, H59N, V75A, L79P, A81T, F91S, L104M, T107M | 1721 | 800 | 0.02 | 676 | 0.02 | 915 | 1.12 | 759 | 0.02 |
| P18S, W46R, E68D, L79P, F91S, T107M, R113G | 1722 | 1359 | 0.03 | 717 | 0.02 | 798 | 0.98 | 737 | 0.02 |
| V9L, P18F, T45A, S65A, S67V, R78K, L79V, F91S, T107M, S114T | 1723 | 130274 | 2.98 | 153569 | 4.04 | 812 | 1.00 | 85605 | 1.76 |
| P18T, M55L, T61R, L79P, F91S, V106I, T107M | 1724 | 133399 | 3.05 | 1906 | 0.05 | 827 | 1.01 | 57927 | 1.19 |
| T15I, P18S, V33M, N35F, T39S, M55L, R78S, L79P, F91S, T107M | 1725 | 7550 | 0.17 | 1015 | 0.03 | 789 | 0.97 | 2709 | 0.06 |
| P18S, Q62K, K70E, L79P, F91S, G92E, R113W | 1726 | 11173 | 0.26 | 691 | 0.02 | 735 | 0.90 | 1951 | 0.04 |
| P18F, F20I, T26M, A47V, E51K, L79P, F91S | 1727 | 136088 | 3.11 | 54026 | 1.42 | 1401 | 1.72 | 96629 | 1.99 |
| P18T, D23A, Q60H, L79P, M90V, F91S, T107M | 1728 | 43795 | 1.00 | 98241 | 2.58 | 888 | 1.09 | 70891 | 1.46 |
| P18S, D23G, C29R, N35D, E37G, M55I, Q62K, S65A, S67G, R78G, L79P, F91S, L104M, T107M, Q110R | 1729 | 1599 | 0.04 | 1030 | 0.03 | 1115 | 1.37 | 1944 | 0.04 |
| A13E, P18S, M36R, Q62K, S67T, L79P, N85D, F91S, T107M | 1730 | | | | Little to no protein produced | | | | |
| V9I, P18T, H49R, L79P, N85D, F91S, L104T, T107M | 1731 | 46375 | 1.06 | 76851 | 2.02 | 794 | 0.97 | 80210 | 1.65 |
| V9A, P18F, T61S, Q62L, L79P, F91S, G111R | 1732 | 26109 | 0.60 | 891 | 0.02 | 825 | 1.01 | 2633 | 0.05 |
| D8E, P18T, T61A, L79P, F91S, T107M | 1733 | | | | Little to no protein produced | | | | |
| P18S, V41A, H49R, S54C, L79S, N85Y, L88P, F91S, L104M, T107M | 1734 | 1098 | 0.03 | 830 | 0.02 | 876 | 1.07 | 1678 | 0.03 |
| V11E, P18H, F20Y, V25E, N35S, H49R, L79P, F91S, T107M, G111R | 1735 | 979 | 0.02 | 846 | 0.02 | 844 | 1.03 | 928 | 0.02 |
| V11A, P18F, D23A, L79P, G80D, V95A, T107M | 1736 | 45249 | 1.04 | 913 | 0.02 | 830 | 1.02 | 33883 | 0.70 |
| P18S, K70R, L79P, F91S, G111R | 1737 | 16180 | 0.37 | 793 | 0.02 | 854 | 1.05 | 1182 | 0.02 |
| P18T, D23A, Q60H, L79P, M90V, F91S, T107M | 1728 | 175673 | 4.02 | 161958 | 4.26 | 879 | 1.08 | 50981 | 1.05 |
| V9L, V11M, P18S, N35S, S54G, Q62K, L79P, L104M, T107M, V115M | 1738 | 2999 | 0.07 | 2315 | 0.06 | 893 | 1.09 | 925 | 0.02 |
| V9L, P18Y, V25A, V38G, M55V, A77T, L79P, M90I, F91S, L104M | 1739 | 138011 | 3.16 | 26015 | 0.68 | 919 | 1.13 | 17970 | 0.37 |
| V10G, P18T, L72Q, L79P, F91S, T107M | 1740 | 4253 | 0.10 | 1584 | 0.04 | 863 | 1.06 | 3643 | 0.07 |
| P18S, H59R, A76G, R78S, L79P | 1741 | 130622 | 2.99 | 79435 | 2.09 | 1009 | 1.24 | 44493 | 0.91 |
| V9A, P18S, M36T, S65G, L79P, F91S, L104T, G111R, S112I | 1742 | 92503 | 2.12 | 989 | 0.03 | 886 | 1.09 | 7850 | 0.16 |
| P18T, S52A, V57A, Q60R, Q62K, S65C, L79P, F91T, N100Y, T107M | 1743 | 187338 | 4.29 | 10579 | 0.28 | 908 | 1.11 | 3791 | 0.08 |
| V11A, P18F, N35D, A47E, Q62K, L79P, F91S, G99D, T107M, S114N | 1744 | | | | Little to no protein produced | | | | |
| V11A, P18T, N35S, L79P, S87T, F91S | 1745 | 218660 | 5.00 | 273825 | 7.20 | 1269 | 1.56 | 69871 | 1.44 |
| V9D, V11M, Q12L, P18S, E37V, M55I, Q60R, K70Q, L79P, F91S, L104M, T107M | 1746 | 8693 | 0.20 | 790 | 0.02 | 852 | 1.04 | 1991 | 0.04 |
| T15S, P18S, Y30H, Q32L, Q62R, L79P, F91S, T107M | 1747 | 16213 | 0.37 | 2092 | 0.06 | 1056 | 1.29 | 6994 | 0.14 |
| CD155-ECD-Fc | — | 43704 | 1.00 | 38032 | 1.00 | 816 | 1.00 | 48638 | 1.00 |
| CD112-IgV | — | 1289 | | 824 | | 17819 | | 1172 | 0.02 |

Example 9

Assessment of Bioactivity of Affinity-Matured IgSF Domain-Containing Molecules Using Jurkat/IL2/TIGIT Reporter Assay This Example describes a Jurkat/IL2/TIGIT reporter assay to assess bioactivity of CD155 domain variant immunomodulatory proteins.

Jurkat effector cells expressing IL-2-luciferase reporter and TIGIT on its surface were suspended in Jurkat Assay buffer (RPMI1640+5% FBS) at $2\times10^6$ cells/mL and 3 μg/mL anti-CD28 was added. Jurkat cells were then plated at 50 μL/well for a total of 100,000 cells per well.

To each well with Jurkat cells plated, 25 μL of each variant CD155 IgV-Fc fusion molecule or control proteins (wild type CD155 ECD-Fc or an Fc control) was added. All proteins were added at four concentrations: 200 nM, 66.6, 22.2 nM and 7.4 nM. The Jurkat cells with CD155 variant IgV-Fc fusion molecules or control proteins were incubated for 15 minutes at room temperature. K562 derived artificial antigen presenting cells (aAPC) cells displaying cell surface anti-CD3 single chain Fv (OKT3) and endogenously expressing CD155 and CD112 were brought to $0.67\times10^6$ cells/mL and 25 μL of cells was added to each well bringing the final volume of each well to 100 μL. Each well had a final ratio of 6:1 Jurkat:K562 cells and protein concentration of 50, 16.7, 5.6 or 1.9 nM and 1.5 μg/mL anti-CD28 per well. Jurkat cells and K562 cells were incubated for 5-6 hours at 37 degrees Celsius in a humidified 5% C02 incubation chamber. Plates were then removed from the incubator and acclimated to room temperature for 15 minutes. 100 μL of a cell lysis and luciferase substrate solution (BioGlo luciferase reagent, Promega) was added to each well and the plates were incubated on an orbital shaker for 10 minutes. Luminescence was measured with a 1 second per well integration time using a BioTek Cytation luminometer.

An average relative luminescence value was determined for each variant CD155 IgV Fc and a fold increase in IL-2 reporter signal was calculated for each variant compared to wildtype CD155 ECD-Fc protein.

As shown in Table 12A, luciferase activity of Jurkat effector cells expressing TIGIT and IL-2-luciferase reporter co-cultured with anti-CD3/CD155 aAPC and variant CD155 IgV-Fc molecules were altered (increased) for some molecules tested. The differences in luminescence signals demonstrate the differences in binding of the variant CD155 IgV-Fc molecules to TIGIT and the resulting blockade of inhibitory activity. In the Table, Column 2 sets forth the SEQ ID NO identifier for each variant IgV domain contained in the tested variant IgV-Fc fusion molecule.

TABLE 12A

| Jurkat/IL-2/TIGIT Reporter Assay | | | |
|---|---|---|---|
| | | Proteins added at 5.6 nM | |
| CD155 Mutation(s) | SEQ ID NO (IgV) | Average Relative Light Units (RLU) | Fold Increase in IL2 Reporter Signal |
| P18F, T26M, L44V, Q62K, L79P, F91S, L104M, G111D | 465 | 502 | 1.0 |
| P18S, T45S, T61K, S65W, S67A, F91S, G111R | 466 | 864 | 1.7 |

TABLE 12A-continued

| Jurkat/IL-2/TIGIT Reporter Assay | | | |
|---|---|---|---|
| | | Proteins added at 5.6 nM | |
| CD155 Mutation(s) | SEQ ID NO (IgV) | Average Relative Light Units (RLU) | Fold Increase in IL2 Reporter Signal |
| P18S, L79P, L104M, T107M | 467 | 538 | 1.1 |
| P18S, S65W, S67A, M90V, V95A, L104Q, G111R | 468 | 649 | 1.3 |
| Wildtype CD155-ECD | 47 (ECD) | 511 | 1.0 |
| Fc control | | 511 | 1.0 |

Additional bioactivity of CD155 domain variant immunomodulatory proteins were assessed using the Jurkat/IL2/TIGIT reporter assay to assess bioactivity of CD155 domain variant immunomodulatory proteins. The assay was carried out substantially as described above, except that all proteins were added at two concentrations: 200 nM or 20 nM. After incubation at room temperature as described above, K562 derived artificial antigen presenting cells (aAPC) cells displaying cell surface anti-CD3 single chain Fv (OKT3) and endogenously expressing CD155 and CD112 were brought to $0.8\times10^6$ cells/mL and 25 μL of cells was added to each well bringing the final volume of each well to 100 μL. Each well had a final ratio of 5:1 Jurkat:K562 cells and protein concentration of 50 nM, or 5 nM and 1.5 μg/mL anti-CD28 per well. Jurkat cells and K562 cells were incubated, cells were lysed and luminescence was measured as described above. A background adjusted, relative luminescence value was determined for each variant CD155 IgV Fc and a fold increase (or decrease) in IL-2 reporter signal was calculated for each variant compared to wildtype CD155 ECD-Fc protein.

As shown in Table 12B-12E, luciferase activity of Jurkat effector cells expressing TIGIT and IL-2-luciferase reporter co-cultured with anti-CD3 expressing aAPC and 50 or 5 nM variant CD155 IgV-Fc molecules were altered for some molecules tested. The differences in luminescence signals demonstrate the differences in binding of the variant CD155 IgV-Fc molecules to TIGIT and the resulting blockade or stimulation of inhibitory activity. In the Table 111B-11C, Column 2 sets forth the SEQ ID NO identifier for each variant IgV domain contained in the tested variant IgV-Fc fusion molecule.

TABLE 12B

| Bioactivity in Jurkat/IL2/TIGIT + K562/OKT3 Reporter Assay | | | |
|---|---|---|---|
| | | Proteins added at 5.0 nM | |
| CD155 Mutation(s) | SEQ ID NO NO. | Background Subtracted RLU | Fold Change Compared to CD155-ECD |
| S52M | 372 | 879 | 2.6 |
| T45Q, S52L, L104E, G111R | 373 | 546 | 1.6 |
| S42G | 374 | 336 | 1.0 |
| Q62F | 375 | 324 | 1.0 |
| S52Q | 376 | 241 | 0.7 |
| S42A, L104Q, G111R | 377 | 328 | 1.0 |
| S42A, S52Q, L104Q, G111R | 378 | 179 | 0.5 |
| S52W, L104E | 379 | 444 | 1.3 |
| S42C | 380 | 110 | 0.3 |
| S52W | 381 | Not tested | |
| S52M, L104Q | 382 | 71 | 0.2 |

TABLE 12B-continued

| | | Bioactivity in Jurkat/IL2/TIGIT + K562/OKT3 Reporter Assay | |
| | | Proteins added at 5.0 nM | |
| CD155 Mutation(s) | SEQ ID NO NO. | Background Subtracted RLU | Fold Change Compared to CD155-ECD |
| --- | --- | --- | --- |
| S42L, S52L, Q62F, L104Q | 383 | 10 | 0.0 |
| S42W | 384 | 567 | 1.7 |
| S42Q | 385 | 762 | 2.3 |
| S52L | 386 | 803 | 2.4 |
| S52R | 387 | 671 | 2.0 |
| L104E | 388 | 448 | 1.3 |
| G111R | 389 | 286 | 0.9 |
| S52E | 390 | 205 | 0.6 |
| Q62Y | 391 | 385 | 1.2 |
| T45S, S52M, L104E | 392 | 377 | 1.1 |
| S42N, L104Q, G111R | 393 | 587 | 1.8 |
| S52M, V57L | 394 | Not tested | |
| S42N, S52Q, Q62F | 395 | 890 | 2.7 |
| S42A, S52L, L104E, G111R | 396 | 508 | 1.5 |
| S42W, S52Q, V57L, Q62Y | 397 | Not tested | |
| L104Q | 398 | 953 | 2.9 |
| S42L, S52Q, L104E | 399 | 518 | 1.6 |
| S42C, S52L | 400 | 219 | 0.7 |
| S42W, S52R, Q62Y, L104Q | 401 | 681 | 2.0 |
| T45Q, S52R, L104E | 402 | 135 | 0.4 |
| S52R, Q62F, L104Q, G111R | 403 | Not tested | |
| T45Q, S52L, V57L, L104E | 404 | 266 | 0.8 |
| S52M, Q62Y | 405 | Not tested | |
| Q62F, L104E, G111R | 406 | 58 | 0.2 |
| T45Q, S52Q | 407 | 0 | 0.0 |
| S52L, L104E | 408 | 322 | 1.0 |
| S42V, S52E | 409 | 224 | 0.7 |
| T45Q, S52R, G111R | 410 | 264 | 0.8 |
| S42G, S52Q, L104E, G111R | 411 | 190 | 0.6 |
| S42N, S52E, V57L, L104E | 412 | 324 | 1.0 |
| Wildtype | 155 | 1048 | 3.1 |
| S42C, S52M, Q62F | 413 | 969 | 2.9 |
| S42L | 414 | 926 | 2.8 |
| Wildtype | 155 | 958 | 2.9 |
| S42A | 415 | 862 | 2.6 |
| S42G, S52L, Q62F, L104Q | 416 | 674 | 2.0 |
| S42N | 417 | 737 | 2.2 |
| CD155-ECD Fc | — | 334 | 1.0 |
| Fc Control | — | 533 | 1.6 |

TABLE 12C

| | | Bioactivity in Jurkat/IL2/TIGIT + K562/OKT3 Reporter Assay | |
| | | Proteins added at 5.0 nM | |
| CD155 Mutation(s) | SEQ ID NO (IgV) | RLU | Fold Increase Compared to CD155-FL ECD |
| --- | --- | --- | --- |
| P18T, S65A, S67V, F91S | 418 | 541 | 1.62 |
| P18T, T45Q, T61R, S65N, S67L | 420 | Not tested | |
| P18F, S65A, S67V, F91S | 421 | Not tested | |
| P18S, L79P, L104M | 423 | Not tested | |
| P18S, L104M | 424 | 805 | 2.41 |
| L79P, L104M | 425 | Not tested | |
| P18T, T45Q, L79P | 426 | 519 | 1.55 |
| P18T, T45Q, T61R, S65H, S67H | 427 | Not tested | |
| A13R, D23G, E37P, S42P, Q62Y, A81E | 430 | Not tested | |
| P18L, E37S, Q62M, G80S, A81P, G99Y, S112N | 433 | Not tested | |
| P18S, L104T | 434 | 754 | 2.26 |
| P18S, Q62H, L79Q, F91S | 435 | 910 | 2.72 |
| P18S, F91S | 161 | 599 | 1.79 |
| P18L, V57T, T61S, S65Y, S67A, L104T | 440 | 821 | 2.46 |
| P18T, T45Q | 441 | 623 | 1.87 |
| T61M, S65W, S67A, L104T | 443 | 893 | 2.67 |
| P18S, V41A, S42G, T45G, L104N | 444 | 647 | 1.94 |
| P18H, S42G, T45I, S52T, G53R, S54H, V57L, H59E, T61S, S65D, E68G, L104N | 445 | Not tested | |
| P18S, S42G, T45V, F58L, S67W, L104N | 446 | Not tested | |
| P18S, T45I, L104N | 447 | 664 | 1.99 |
| P18S, S42G, T45G, L104N, V106A | 448 | 488 | 1.46 |
| P18H, H40R, S42G, T45I, S52T, G53R, S54H, V57L, H59E, T61S, S65D, E68G, L104Y, V106L, F108H | 449 | 442 | 1.32 |
| P18S, T45Q, L79P, L104T | 451 | 538 | 1.61 |
| P18L, Q62R | 452 | Not tested | |
| P18L, H49R, L104T, D116N | 454 | 703 | 2.10 |
| S65T, L104T | 456 | 816 | 2.44 |
| P18L, A47V, Q62Y, E73D, L104T | 458 | 776 | 2.32 |
| P18L, S42P, T45Q, T61G, S65H, S67E, L104T, D116N | 460 | 327 | 0.98 |
| T45Q, S52E, Q62F, L104E | 464 | 514 | 1.54 |
| CD155-ECD Fc | 47 (ECD) | 334 | 1.00 |
| Fc Control | — | 533 | 1.60 |

TABLE 12D

| | | Jurkat/IL2/TIGIT + K562/OKT3 Reporter Assay Results | |
| | | Proteins added at 50 nM | |
| CD155 Mutation(s) | SEQ ID NO (IgV) | RLU | Normalized Fold Change from CD155-ECD |
| --- | --- | --- | --- |
| P18S, A47G, L79P, F91S, L104M, T107A, R113W | 1207 | 3096 | 5.0 |
| P18T, D23G, S24A, N35D, H49L, L79P, F91S, L104M, G111R | 1208 | 1981 | 3.2 |
| V9L, P18S, Q60R, V75L, L79P, R89K, F91S, L104E, G111R | 1209 | 1113 | 1.8 |
| P18S, H49R, E73D, L79P, N85D, F91S, V95A, L104M, G111R | 1210 | Little to no protein produced | |
| V11A, P18S, L79P, F91S, L104M, G111R | 1211 | 280 | 0.4 |
| V11A, P18S, S54R, Q60P, Q62K, L79P, N85D, F91S, T107M | 1212 | 1644 | 2.6 |
| P18T, S52P, S65A, S67V, L79P, F91S, L104M, G111R | 1213 | 2216 | 3.6 |
| P18T, M36T, L79P, F91S, G111R | 1214 | 2586 | 4.1 |
| D8G, P18S, M36I, V38A, H49Q, A76E, F91S, L104M, T107A, R113W | 1215 | 2502 | 4.0 |
| P18S, S52P, S65A, S67V, L79P, F91S, L104M, T107S, R113W | 1216 | −52 | −0.1 |
| T15I, P18T, L79P, F91S, L104M, G111R | 1217 | 225 | 0.4 |
| P18F, T26M, L44V, Q62K, L79P, E82D, F91S, L104M, G111D | 1218 | 2487 | 4.0 |
| P18T, E37G, G53R, Q62K, L79P, F91S, E98D, L104M, T107M | 1219 | 5382 | 8.6 |
| P18L, K70E, L79P, F91S, V95A, G111R | 1220 | 1480 | 2.4 |
| V9I, Q12K, P18F, S65A, S67V, L79P, L104T, G111R, S112I | 1221 | 1428 | 2.3 |

TABLE 12D-continued

| | | | |
|---|---|---|---|
| | | Proteins added at 50 nM | |
| CD155 Mutation(s) | SEQ ID NO (IgV) | RLU | Normalized Fold Change from CD155-ECD |
| P18F, S65A, S67V, F91S, L104M, G111R | 1222 | 351 | 0.6 |
| V9I, V10I, P18S, F20S, T45A, L79P, F91S, L104M, F108Y, G111R, S112V | 1223 | −1183 | −1.9 |
| V9L, P18L, L79P, M90I, F91S, T102S, L104M, G111R | 1224 | 1493 | 2.4 |
| P18C, T26M, L44V, M55I, Q62K, L79P, F91S, L104M, T107M | 1225 | 979 | 1.6 |
| V9I, P18T, D23G, L79P, F91S, G111R | 1226 | 1228 | 2.0 |
| P18F, L79P, M90L, F91S, V95A, L104M, G111R | 1227 | 1085 | 1.7 |
| P18F, L79P, M90L, F91S, V95A, L104M, G111R | 1227 | 1455 | 2.3 |
| P18T, M36T, S65A, S67E, L79Q, A81T, F91S, G111R | 1228 | −551 | −0.9 |
| V9L, P18T, Q62R, L79P, F91S, L104M, G111R | 1229 | 4588 | 7.4 |
| CD155-ECD-Fc | — | 624 | 1.0 |
| Fc Control | — | 0 | 0.0 |

TABLE 12E

| | | | |
|---|---|---|---|
| Bioactivity in Jurkat/IL2 + K562/OKT3 Reporter Assay | | | |
| CD155 Mutation(s) | SEQ ID NO (IgV) | RLU | Normalized Fold Change from CD155-ECD |
| P18T, G19D, M36T, S54N, L79P, L83Q, F91S, T107M, F108Y | 1702 | 215 | 0.3 |
| V9L, P18L, M55V, S69L, L79P, A81E, F91S, T107M | 1703 | 1940 | 3.1 |
| P18F, H40Q, T61K, Q62K, L79P, F91S, L104M, T107V | 1704 | 691 | 1.1 |
| P18S, Q32R, Q62K, R78G, L79P, F91S, T107A, R113W | 1705 | −1361 | −2.2 |
| Q12H, P18T, L21S, G22S, V57A, Q62R, L79P, F91S, T107M | 1706 | −2551 | −4.1 |
| V9I, P18S, S24P, H49Q, F58Y, Q60R, Q62K, L79P, F91S, T107M | 1707 | 658 | 1.1 |
| P18T, W46C, H49R, S65A, S67V, A76T, L79P, S87T, L104M | 1708 | −2131 | −3.4 |
| P18S, S42T, E51G, L79P, F91S, G92W, T107M | 1709 | −1780 | −2.9 |
| P18S, S42T, E51G, L79P, F91S, G92W, T107M | 1709 | −1502 | −2.4 |
| V10F, T15S, P18L, R48Q, L79P, F91S, T107M, V115M | 1710 | −2144 | −3.4 |
| P18S, L21M, Y30F, N35D, R84W, F91S, T107M, D116G | 1711 | −1385 | −2.2 |
| P18F, E51V, S54G, Q60R, L79Q, E82G, S87T, M90I, F91S, G92R, T107M | 1712 | 3620 | 5.8 |
| Q16H, P18F, F91S, T107M | 1713 | Little to no protein produced | |
| P18T, D23G, Q60R, S67L, L79P, F91S, T107M, V115A | 1714 | 5374 | 8.6 |
| D8G, V9I, V11A, P18T, T26M, S52P, L79P, F91S, G92A, T107L, V115A | 1715 | 5235 | 8.4 |
| V9I, P18F, A47E, G50S, E68G, L79P, F91S, T107M | 1716 | 1870 | 3.0 |
| P18S, M55I, Q62K, S69P, L79P, F91S, T107M | 1717 | Little to no protein produced | |
| P18T, T39S, S52P, S54R, L79P, F91S, T107M | 1718 | −51 | −0.1 |
| P18S, D23N, L79P, F91S, T107M, S114N | 1719 | Little to no protein produced | |
| P18S, P34S, E51V, L79P, F91S, G111R | 1720 | 2222 | 2.1 |
| P18S, H59N, V75A, L79P, A81T, F91S, L104M, T107M | 1721 | 3635 | 3.5 |
| P18S, W46R, E68D, L79P, F91S, T107M, R113G | 1722 | 958 | 0.9 |
| V9L, P18F, T45A, S65A, S67V, R78K, L79V, F91S, T107M, S114T | 1723 | 6203 | 6.0 |
| P18T, M55L, T61R, L79P, F91S, V106I, T107M | 1724 | 4661 | 4.5 |
| T15I, P18S, V33M, N35F, T39S, M55L, R78S, L79P, F91S, T107M | 1725 | 1350 | 1.3 |
| P18S, Q62K, K70E, L79P, F91S, G92E, R113W | 1726 | 2077 | 2.0 |
| P18F, F20I, T26M, A47V, E51K, L79P, F91S | 1727 | 3188 | 3.1 |
| P18T, D23A, Q60H, L79P, M90V, F91S, T107M | 1728 | 6959 | 6.7 |
| P18S, D23G, C29R, N35D, E37G, M55I, Q62K, S65A, S67G, R78G, L79P, F91S, L104M, T107M, Q110R | 1729 | 1199 | 1.2 |
| A13E, P18S, M36R, Q62K, S67T, L79P, N85D, F91S, T107M | 1730 | Little to no protein produced | |
| V9I, P18T, H49R, L79P, N85D, F91S, L104T, T107M | 1731 | 4165 | 4.0 |
| V9A, P18F, T61S, Q62L, L79P, F91S, G111R | 1732 | 1369 | 1.3 |
| D8E, P18T, T61A, L79P, F91S, T107M | 1733 | Little to no protein produced | |

TABLE 12E-continued

| | | | Normalized Fold Change from |
|---|---|---|---|
| CD155 Mutation(s) | SEQ ID NO (IgV) | RLU | CD155-ECD |
| P18S, V41A, H49R, S54C, L79S, N85Y, L88P, F91S, L104M, T107M | 1734 | −1076 | −1.0 |
| V11E, P18H, F20Y, V25E, N35S, H49R, L79P, F91S, T107M, G111R | 1735 | −624 | −0.6 |
| V11A, P18F, D23A, L79P, G80D, V95A, T107M | 1736 | 573 | 0.6 |
| P18S, K70R, L79P, F91S, G111R | 1737 | −770 | −0.7 |
| P18T, D23A, Q60H, L79P, M90V, F91S, T107M | 1728 | 2504 | 2.4 |
| V9L, V11M, P18S, N35S, S54G, Q62K, L79P, L104M, T107M, V115M | 1738 | −696 | −0.7 |
| V9L, P18Y, V25A, V38G, M55V, A77T, L79P, M90I, F91S, L104M | 1739 | 1198 | 1.2 |
| V10G, P18T, L72Q, L79P, F91S, T107M | 1740 | 210 | 0.2 |
| P18S, H59R, A76G, R78S, L79P | 1741 | 2721 | 2.6 |
| V9A, P18S, M36T, S65G, L79P, F91S, L104T, G111R, S112I | 1742 | 1090 | 1.1 |
| P18T, S52A, V57A, Q60R, Q62K, S65C, L79P, F91T, N100Y, T107M | 1743 | 2129 | 2.1 |
| V11A, P18F, N35D, A47E, Q62K, L79P, F91S, G99D, T107M, S114N | 1744 | Little to no protein produced | |
| V11A, P18T, N35S, L79P, S87T, F91S | 1745 | 2193 | 2.1 |
| V9D, V11M, Q12L, P18S, E37V, M55I, Q60R, K70Q, L79P, F91S, L104M, T107M | 1746 | −394 | −0.4 |
| T15S, P18S, Y30H, Q32L, Q62R, L79P, F91S, T107M | 1747 | 189 | 0.2 |
| CD155-ECD-Fc | — | 1034 | 1.0 |
| Fc Control | — | 0 | 0.0 |

*Bioactivity in Jurkat/IL2 + K562/OKT3 Reporter Assay*

Example 10

Additional Affinity Modified IgSF Domains

This examples describe the design, creation, and screening of additional affinity modified CD80 (B7-1), CD112, PD-L1, PD-L2 and CD86 (B37-2) immunomodulatory proteins, which are other components of the immune synapse (IS) that have a demonstrated dual role in both immune activation and inhibition. Affinity-modified NK(p30 variants also were generated and screened. These examples demonstrate that affinity modification of IgSF domains yields proteins that can act to both increase and decrease immunological activity. Various combinations of those domains fused in pairs (i.e., stacked) with a variant affinity modified CD155 to form a Type II immunomodulatory protein to achieve immunomodulatory activity.

Mutant DNA constructs of encoding a variant of the ECD domain of human CD80, or IgV domains of CD112, PD-L1 and PD-L2 for translation and expression as yeast display libraries were generated substantially as described in Example 1. For target libraries that target specific residues for complete or partial randomization with degenerate codons and/or random libraries were constructed to identify variants of the IgV of CD80 (SEQ ID NO:1043), variants of the IgV of CD112 (SEQ ID NO: 1367), variants of the IgV of PD-L1 (SEQ ID NO:665), and variants of the IgV of PD-L2 (SEQ ID NO:726) substantially as described in Example 1. Similar methods also were used to generate libraries of the IgC-like domain of NKp30 (SEQ ID NO:1168).

The degenerate or random library DNA was introduced into yeast substantially as described in Example 2 to generate yeast libraries. The libraries were used to select yeast expressing affinity modified variants of CD80, CD112, PD-L1, PD-L2, CD86 (B7-2), and NKp30 substantially as described in Example 3. Cells were processed to reduce non-binders and to enrich for CD80, CD112, PD-L1 or PD-L2 variants with the ability to bind their exogenous recombinant counter-structure proteins substantially as described in Example 3.

With CD80, CD86 and NKp30 libraries, target ligand proteins were sourced from R&D Systems (USA) as follows: human rCD28.Fc (i.e., recombinant CD28-Fc fusion protein), rPD-L1.Fc, rCTLA4.Fc, and rB7H6.Fc. Two-color flow cytometry was performed substantially as described in Example 3. Yeast outputs from the flow cytometric sorts were assayed for higher specific binding affinity. Sort output yeast were expanded and re-induced to express the particular IgSF affinity modified domain variants they encode. This population then can be compared to the parental, wild-type yeast strain, or any other selected outputs, such as the bead output yeast population, by flow cytometry.

In the case of NKp30 yeast variants selected for binding to B7-H6, the F2 sort outputs gave MFI values of 533 when stained with 16.6 nM rB7H6.Fc, whereas the parental NKp30 strain MFI was measured at 90 when stained with the same concentration of rB7H6.Fc (6-fold improvement).

Among the NKp30 variants that were identified, was a variant that contained mutations L30V/A60V/S64P/S86G with reference to positions in the NKp30 extracellular domain corresponding to positions set forth in SEQ ID NO:54.

For CD80 variants provided in Tables 13A-B, CD80 libraries consisted of positive selection with the desired counter structure CTLA4 and negative selection with the counter structure CD28. For PD-L1 and PD-L2, yeast display targeted or random PD-L1 or PD-L2 libraries were selected against PD-1. Alternatively, for PD-L1, selections were performed with human rCD80.Fc (i.e., human recombinant CD80 Fc fusion protein from R&D Systems, USA). Selections were carried out largely as described for PD-1 . . . . This was then followed by two to three rounds of flow cytometry sorting using exogenous counter-structure protein staining to enrich the fraction of yeast cells that displays improved binders. Magnetic bead enrichment and selections by flow cytometry are essentially as described in Miller, K. D. Current Protocols in Cytometry 4.7.1-4.7.30, July 2008. PD-L1 variants in Table 14A-B were assessed for binding to cell-expressed counter structures. Additional PD-L1 variants identified in the screen as described above are set forth in Table 14C.

For CD112 variants provided in Table 16A, CD112 libraries were selected against each of TIGIT, CD112R, and CD226, separately. For additional CD112 variants provided in Table 16B-C, selection involved two positive selections with the desired counter structures TIGIT and CD112R followed by one negative selection with the counter structure CD226 to select away from CD226 and improve binding specificity of the variant CD112. Selection was performed essentially as described in Example 3 above except the concentrations of the counter structures (TIGIT/CD112R) and selection stringency of the positive sorts were varied to optimize lead identification. The concentration of CD226 for the negative selection was kept at 100 nM.

Exemplary selection outputs were reformatted as immunomodulatory proteins containing an affinity modified (variant) IgV of CD80, variant IgV of CD112, variant IgV or ECD of PD-L1, variant IgV of PD-L2, each fused to an Fc molecule (variant IgV-Fc fusion molecules) substantially as described in Example 4 and the Fc-fusion protein was expressed and purified substantially as described in Example 5.

Binding of exemplary IgSF domain variants to cell-expressed counter structures was then assessed substantially as described in Example 6. Cells expressing cognate binding partners were produced and binding studies and flow cytometry were carried out substantially as described in Example 6. In addition, the bioactivity of the Fc-fusion variant protein was characterized by either mixed lymphocyte reaction (MLR) or anti-CD3 coimmobilization assay substantially as described in Example 6.

As above, for each Table, the exemplary amino acid substitutions are designated by amino acid position number corresponding to the respective reference unmodified ECD sequence (Table 2). The amino acid position is indicated in the middle, with the corresponding unmodified (e.g. wild-type) amino acid listed before the number and the identified variant amino acid substitution listed (or inserted designated by a) after the number.

Also shown is the binding activity as measured by the Mean Fluorescence Intensity (MFI) value for binding of each variant Fc-fusion molecule to cells engineered to express the cognate counter structure ligand the ratio of the MFI compared to the binding of the corresponding unmodified Fc fusion molecule not containing the amino acid substitution(s) to the same cell-expressed counter structure ligand. The functional activity of the PD-L2 variant Fc-fusion molecules to modulate the activity of T cells also is shown based on the calculated levels of IFN-gamma in culture supernatants (pg/ml) generated with the indicated variant Fc fusion molecule in an MLR assay. Table 15B also depicts the ratio of IFN-gamma produced by each variant IgV-Fc compared to the corresponding unmodified IgV-Fc in an MLR assay.

As shown in Tables 13A-16C, the selections resulted in the identification of a number of CD112, PD-L1, PD-L2, and CD80 IgSF domain variants that were affinity-modified to exhibit increased binding for at least one, and in some cases more than one, cognate counter structure ligand. In addition, the results showed that affinity modification of the variant molecules also exhibited improved activities to both increase and decrease immunological activity.

TABLE 13A

| | | CTLA4 | | CD28 | | PD-L1 | | |
| CD80 mutation(s) | SEQ ID NO (IgV) | MFI at 66.6 nM | Fold change to WT | MFI at 66.6 nM | Fold change to WT | MFI at 22.2 nM | Fold change to WT | Ratio of CTLA4:CD28 |
| --- | --- | --- | --- | --- | --- | --- | --- | --- |
| L70P | 1044 | | | Not tested | | | | |
| I30F/L70P | 1045 | | | Not tested | | | | |
| Q27H/T41S/A71D | 1046 | 368176 | 2.3 | 25051 | 1.01 | 24181 | N/A | 14.7 |
| I30T/L70R | 1047 | 2234 | 0.0 | 2596 | 0.10 | 5163 | N/A | 0.9 |
| T13R/C16R/L70Q/A71D | 1048 | 197357 | 1.2 | 16082 | 0.65 | 9516 | N/A | 12.3 |
| T57I | 1049 | 393810 | 2.4 | 23569 | 0.95 | 3375 | N/A | 16.7 |
| M43I/C82R | 1050 | 3638 | 0.0 | 3078 | 0.12 | 7405 | N/A | 1.2 |
| V22L/M38V/M47T/A71D/ L85M | 1051 | 175235 | 1.1 | 3027 | 0.12 | 6144 | N/A | 57.9 |
| I30V/T57I/L70P/A71D/ A91T | 1052 | 116085 | 0.7 | 10129 | 0.41 | 5886 | N/A | 11.5 |
| V22I/L70M/A71D | 1053 | 163825 | 1.0 | 22843 | 0.92 | 33404 | N/A | 7.2 |
| N55D/L70P/E77G | 1054 | | | Not tested | | | | |
| T57A/I69T | 1055 | | | Not tested | | | | |
| N55D/K86M | 1056 | 3539 | 0.0 | 3119 | 0.13 | 5091 | N/A | 1.1 |
| L72P/T79I | 1057 | 50176 | 0.3 | 3397 | 0.14 | 6023 | N/A | 14.8 |
| L70P/F92S | 1058 | 4035 | 0.0 | 2948 | 0.12 | 6173 | N/A | 1.4 |
| T79P | 1059 | 2005 | 0.0 | 2665 | 0.11 | 4412 | N/A | 0.8 |
| E35D/M47I/L65P/D90N | 1060 | 4411 | 0.0 | 2526 | 0.10 | 4034 | N/A | 1.7 |
| L25S/E35D/M47I/D90N | 1061 | 61265 | 0.4 | 4845 | 0.20 | 20902 | N/A | 12.6 |
| Q27X*/S44P/I67T/P74S/ E81G/E95D | 1062 | 195637 | 1.2 | 17524 | 0.71 | 17509 | N/A | 11.2 |
| A71D | 1063 | 220090 | 1.4 | 16785 | 0.68 | 29642 | N/A | 13.1 |
| T13A/Q27X*/I61N/A71D | 1064 | 195061 | 1.2 | 17519 | 0.71 | 21717 | N/A | 11.1 |
| E81K/A91S | 1065 | 98467 | 0.6 | 3309 | 0.13 | 44557 | N/A | 29.8 |
| A12V/M47V/L70M | 1066 | 81616 | 0.5 | 7400 | 0.30 | 31077 | N/A | 11.0 |
| K34E/T41A/L72V | 1067 | 88982 | 0.6 | 3755 | 0.15 | 35293 | N/A | 23.7 |
| T41S/A71D/V84A | 1068 | 103010 | 0.6 | 5573 | 0.22 | 83541 | N/A | 18.5 |
| E35D/A71D | 1069 | 106069 | 0.7 | 18206 | 0.73 | 40151 | N/A | 5.8 |

TABLE 13A-continued

Variant CD80 Binding to HEK293 Cells Transfected with CTLA4, CD28 or PD-L1

| | | CTLA4 | | CD28 | | PD-L1 | | |
|---|---|---|---|---|---|---|---|---|
| CD80 mutation(s) | SEQ ID NO (IgV) | MFI at 66.6 nM | Fold change to WT | MFI at 66.6 nM | Fold change to WT | MFI at 22.2 nM | Fold change to WT | Ratio of CTLA4:CD28 |
| E35D/M47I | 1070 | 353590 | 2.2 | 14350 | 0.58 | 149916 | N/A | 24.6 |
| K36R/G78A | 1071 | 11937 | 0.1 | 2611 | 0.11 | 5715 | N/A | 4.6 |
| Q33E/T41A | 1072 | 8292 | 0.1 | 2442 | 0.10 | 3958 | N/A | 3.4 |
| M47V/N48H | 1073 | 207012 | 1.3 | 14623 | 0.59 | 145529 | N/A | 14.2 |
| M47L/V68A | 1074 | 74238 | 0.5 | 13259 | 0.53 | 11223 | N/A | 5.6 |
| S44P/A71D | 1075 | 8839 | 0.1 | 2744 | 0.11 | 6309 | N/A | 3.2 |
| Q27H/M43I/A71D/R73S | 1076 | 136251 | 0.8 | 12391 | 0.50 | 8242 | N/A | 11.0 |
| E35D/T57I/L70Q/A71D | 1078 | 121901 | 0.8 | 21284 | 0.86 | 2419 | N/A | 5.7 |
| M47I/E88D | 1079 | 105192 | 0.7 | 7337 | 0.30 | 97695 | N/A | 14.3 |
| M42I/I61V/A71D | 1080 | 54478 | 0.3 | 6074 | 0.24 | 4226 | N/A | 9.0 |
| P51A/A71D | 1081 | 67256 | 0.4 | 4262 | 0.17 | 5532 | N/A | 15.8 |
| H18Y/M47I/T57I/A71G | 1082 | 136455 | 0.8 | 20081 | 0.81 | 13749 | N/A | 6.8 |
| V20I/M47V/T57I/V84I | 1083 | 183516 | 1.1 | 26922 | 1.08 | 3583 | N/A | 6.8 |
| WT | 1043 | 161423 | 1.0 | 24836 | 1.00 | Not tested | N/A | 6.5 |

*Stop codon at indicated position

TABLE 13B

Variant CD80 Binding to HEK293 Cells Transfected with CTLA4, CD28 or PD-L1

| | | CTLA4 | | CD28 | | PD-L1 | | |
|---|---|---|---|---|---|---|---|---|
| CD80 mutation(s) | SEQ ID NO (IgV) | MFI at 66.6 nM | Fold change to WT | MFI at 66.6 nM | Fold change to WT | MFI at 22.2 nM | Fold change to WT | Ratio of CTLA4:CD28 |
| V20I/M47V/A71D | 1084 | 149937 | 7.23 | 15090 | 9.33 | 9710 | 5.48 | 9.9 |
| A71D/L72V/E95K | 1085 | 140306 | 6.77 | 6314 | 3.90 | 8417 | 4.75 | 22.2 |
| V22L/E35G/A71D/L72P | 1086 | 152588 | 7.36 | 8150 | 5.04 | 1403 | 0.79 | 18.7 |
| E35D/A71D | 1087 | 150330 | 7.25 | 14982 | 9.26 | 13781 | 7.77 | 10.0 |
| E35D/I67L/A71D | 1088 | 146087 | 7.04 | 11175 | 6.91 | 9354 | 5.28 | 13.1 |
| T13R/M42V/M47I/A71D | 1090 | 108900 | 5.25 | 16713 | 10.33 | 1869 | 1.05 | 6.5 |
| E35D | 1091 | 116494 | 5.62 | 3453 | 2.13 | 25492 | 14.38 | 33.7 |
| E35D/M47I/L70M | 1092 | 116531 | 5.62 | 14395 | 8.90 | 49131 | 27.71 | 8.1 |
| E35D/A71/L72V | 1093 | 134252 | 6.47 | 11634 | 7.19 | 13125 | 7.40 | 11.5 |
| E35D/M43L/L70M | 1094 | 102499 | 4.94 | 3112 | 1.92 | 40632 | 22.92 | 32.9 |
| A26P/E35D/M43I/L85Q/ E88D | 1095 | 83139 | 4.01 | 5406 | 3.34 | 9506 | 5.36 | 15.4 |
| E35D/D46V/L85Q | 1096 | 85989 | 4.15 | 7510 | 4.64 | 38133 | 21.51 | 11.4 |
| Q27L/E35D/M47I/T57I/ L70Q/E88D | 1097 | 59793 | 2.88 | 14011 | 8.66 | 1050 | 0.59 | 4.3 |
| Q27H/E35G/A71D/L72P/ T79I | 1089 | 85117 | 4.10 | 10317 | 6.38 | 1452 | 0.82 | 8.3 |
| M47V/I69F/A71D/V83I | 1098 | 76944 | 3.71 | 15906 | 9.83 | 3399 | 1.92 | 4.8 |
| E35D/T57A/A71D/L85Q | 1099 | 85724 | 4.13 | 3383 | 2.09 | 1764 | 0.99 | 25.3 |
| H18Y/A26T/E35D/A71D/ L85Q | 1100 | 70878 | 3.42 | 6487 | 4.01 | 8026 | 4.53 | 10.9 |
| E35D/M47L | 1101 | 82410 | 3.97 | 11508 | 7.11 | 58645 | 33.08 | 7.2 |
| E23D/M42V/M43I/I58V/ L70R | 1102 | 37331 | 1.80 | 10910 | 6.74 | 2251 | 1.27 | 3.4 |
| V68M/L70M/A71D/E95K | 1103 | 56479 | 2.72 | 10541 | 6.51 | 38182 | 21.53 | 5.4 |
| N55I/T57I/I69F | 1104 | 2855 | 0.14 | 1901 | 1.17 | 14759 | 8.32 | 1.5 |
| E35D/M43I/A71D | 1105 | 63789 | 3.08 | 6369 | 3.94 | 27290 | 15.39 | 10.0 |
| T41S/T57I/L70R | 1106 | 59844 | 2.89 | 4902 | 3.03 | 19527 | 11.01 | 12.2 |
| H18Y/A71D/L72P/E88V | 1107 | 68391 | 3.30 | 8862 | 5.48 | 1085 | 0.61 | 7.7 |
| V20I/A71D | 1108 | 60323 | 2.91 | 10500 | 6.49 | 3551 | 2.00 | 5.7 |
| E23G/A26S/E35D/T62N/ A71D/L72V/L85M | 1109 | 59025 | 2.85 | 5484 | 3.39 | 10662 | 6.01 | 10.8 |
| A12T/E24D/E35D/D46V/ I61V/L72P/E95V | 1110 | 63738 | 3.07 | 7411 | 4.58 | 1221 | 0.69 | 8.6 |
| V22L/E35D/M43L/A71G/ D76H | 1111 | 2970 | 0.14 | 1498 | 0.93 | 1851 | 1.04 | 2.0 |
| E35G/K54E/A71D/L72P | 1112 | 71899 | 3.47 | 3697 | 2.29 | 1575 | 0.89 | 19.4 |
| L70Q/A71D | 1113 | 45012 | 2.17 | 18615 | 11.50 | 1692 | 0.95 | 2.4 |
| A26E/E35D/M47L/L85Q | 1114 | 40325 | 1.94 | 2266 | 1.40 | 55548 | 31.33 | 17.8 |

TABLE 13B-continued

Variant CD80 Binding to HEK293 Cells Transfected with CTLA4, CD28 or PD-L1

| CD80 mutation(s) | SEQ ID NO (IgV) | CTLA4 | | CD28 | | PD-L1 | | Ratio of CTLA4:CD28 |
|---|---|---|---|---|---|---|---|---|
| | | MFI at 66.6 nM | Fold change to WT | MFI at 66.6 nM | Fold change to WT | MFI at 22.2 nM | Fold change to WT | |
| D46E/A71D | 1115 | 69674 | 3.36 | 16770 | 10.36 | 22777 | 12.85 | 4.2 |
| Y31H/E35D/T41S/V68L/ K93R/R94W | 1116 | 3379 | 0.16 | 2446 | 1.51 | 18863 | 10.64 | 1.4 |
| WT CD80 IgV-Fc | 1063) IgV) | 20739 | 1.00 | 1618 | 1.00 | 1773 | 1.00 | 12.8 |
| WT CD80 IgV/IgC-Fc | — | 72506 | 3.50 | 3072 | 1.90 | 4418 | 2.49 | 23.6 |

TABLE 14A

Selected PD-L1 variants and binding data.

| PD-L1 Mutation(s) | SEQ ID NO (IgV) | Binding to Jurkat/PD-1 Cells | |
|---|---|---|---|
| | | MFI at 50 nM | Fold increase over wildtype PD-L1 IgV-Fc |
| K28N, M41V, N45T, H51N, K57E | 600 | 12585 | 2.4 |
| I20L, I36T, N45D, I47T | 601 | 3119 | 0.6 |
| I20L, M41K, K44E | 602 | 9206 | 1.8 |
| P6S, N45T, N78I, I83T | 603 | 419 | 0.1 |
| N78I | 604 | 2249 | 0.4 |
| M41K, N78I | 605 | Little or no protein produced | |
| N17D, N45T, V50A, D72G | 611 | Little or no protein produced | |
| I20L, F49S | 612 | Little or no protein produced | |
| N45T, V50A | 613 | 23887 | 4.6 |
| I20L, N45T, N78I | 614 | 29104 | 5.6 |
| N45T, N78I | 606 | 24865 | 4.7 |
| I20L, N45T | 607 | 24279 | 4.6 |
| I20L, N45T, V50A | 615 | 34158 | 6.5 |
| N45T | 608 | 6687 | 1.3 |
| M41K | 609 | 5079 | 1.0 |
| M41V, N45T | 616 | Little or no protein produced | |
| M41K, N45T | 617 | Little or no protein produced | |
| A33D, S75P, D85E | 618 | 685 | 0.1 |
| M18I, M41K, D43G, H51R, N78I | 619 | 20731 | 4.0 |
| V11E, I20L, I36T, N45D, H60R, S75P | 620 | 3313 | 0.6 |
| A33D, V50A | 621 | Little or no protein produced | |
| S16G, A33D, K71E, S75P | 622 | Little or no protein produced | |
| E27G, N45T, M97I | 623 | 881 | 0.2 |
| E27G, N45T, K57R | 624 | 5022 | 1.0 |
| A33D, E53V | 625 | 650 | 0.1 |
| D43G, N45D, V58A | 626 | 63960 | 12.2 |
| E40G, D43V, N45T, V50A | 627 | 809 | 0.2 |
| Y14S, K28E, N45T | 628 | 16232 | 3.1 |
| A33D, N78S | 629 | 1725 | 0.3 |
| A33D, N78I | 630 | 8482 | 1.6 |
| A33D, N45T | 631 | 17220 | 3.3 |
| A33D/N45T/N78I | 632 | Little or no protein produced | |
| E27G, N45T, V50A | 633 | 25267 | 4.8 |
| N45T, V50A, N78S | 634 | 28572 | 5.4 |
| N45T, V50A | 613 | 18717 | 3.6 |
| I20L, N45T, V110M | 635 | 464 | 0.1 |
| I20L, I36T, N45T, V50A | 636 | 7658 | 1.5 |
| N45T, L74P, S75P | 637 | 5251 | 1.0 |
| N45T, S75P | 638 | 12200 | 2.3 |
| S75P, K106R | 639 | 388 | 0.1 |
| S75P | 640 | 1230 | 0.2 |
| A33D, S75P | 643 | 306 | 0.1 |
| A33D, S75P, D104G | 642 | 251 | 0.0 |
| A33D, S75P | 641 | 1786 | 0.3 |
| I20L, E27G, N45T, V50A | 644 | 29843 | 5.7 |
| I20L, E27G, D43G, N45D, V58A, N78I | 645 | 69486 | 13.3 |
| I20L, D43G, N45D, V58A, N78I | 646 | 72738 | 13.9 |

TABLE 14A-continued

Selected PD-L1 variants and binding data.

| PD-L1 Mutation(s) | SEQ ID NO (IgV) | Binding to Jurkat/PD-1 Cells | |
|---|---|---|---|
| | | MFI at 50 nM | Fold increase over wildtype PD-L1 IgV-Fc |
| I20L, A33D, D43G, N45D, V58A, N78I | 647 | 80205 | 15.3 |
| I20L, D43G, N45D, N78I | 648 | 67018 | 12.8 |
| E27G, N45T, V50A, N78I | 649 | 30677 | 5.9 |
| N45T, V50A, N78I | 650 | 32165 | 6.1 |
| V11A, I20L, E27G, D43G, N45D, H51Y, S99G | 651 | 73727 | 14.1 |
| I20L, E27G, D43G, N45T, V50A | 652 | 36739 | 7.0 |
| I20L, K28E, D43G, N45D, V58A, Q89R, G101G-ins (G101GG) | 1755 | 80549 | 15.4 |
| I20L, I36T, N45D | 610 | 16870 | 3.2 |
| I20L, K28E, D43G, N45D, E53V, V58A, N78I | 655 | 139 | 0.0 |
| A33D, D43G, N45D, V58A, S75P | 656 | 58484 | 11.2 |
| K23R, D43G, N45D | 657 | 67559 | 12.9 |
| I20L, D43G, N45D, V58A, N78I, D90G, G101D | 658 | 259 | 0.0 |
| D43G, N45D, L56Q, V58A, G101G-ins (G101GG) | 1755 | 88277 | 16.8 |
| I20L, K23E, D43G, N45D, V58A, N78I | 660 | 89608 | 17.1 |
| I20L, K23E, D43G, N45D, V50A, N78I | 661 | 88829 | 16.9 |
| T19I, E27G, N45I, V50A, N78I, M97K | 662 | 25496 | 4.9 |
| I20L, M41K, D43G, N45D | 663 | 599 | 0.1 |
| K23R, N45T, N78I | 664 | 84980 | 16.2 |
| Full length PD-L1 Fc | — | 18465 | 3.5 |
| Wild type PD-L1 IgV | 665 (IgV) | 5243 | 1.0 |
| Anti-PD-1 monoclonal antibody (nivolumab) | — | 79787 | 15.2 |
| Human IgG | — | 198 | 0.0 |

TABLE 14B

| | | PD-1 | | CD80 | |
|---|---|---|---|---|---|
| PD-L1 Mutation(s) | SEQ ID NO (ECD) | MFI at 20 nM | Fold Change Compared to WT PD-L1 | MFI at 20 nM | Fold Change Compared to WT PD-L1 |
| K57R, S99G | 1757 | 2953 | 0.9 | 16253 | 121.3 |
| K57R, S99G, F189L | 1758 | 1930 | 0.6 | 12906 | 96.3 |
| M18V, M97L, F193S, R195G, E200K, H202Q | 1759 | 69 | 0.0 | 241 | 1.8 |
| I36S, M41K, M97L, K144Q, R195G, E200K, H202Q, L206F | 1760 | 3498 | 1.1 | 68715 | 512.8 |
| C22R, Q65L, L124S, K144Q, R195G, E200N, H202Q, T221L | 1761 | Little or no protein produced | | | |
| M18V, I98L, L124S, P198T, L206F | 1762 | 2187 | 0.7 | 143 | 1.1 |
| S99G, N117S, I148V, K171R, R180S | 1763 | Little or no protein produced | | | |
| I36T, M97L, A103V, Q155H | 1764 | 120 | 0.0 | 128 | 1.0 |
| K28I, S99G | 1765 | 830 | 0.3 | 693 | 5.2 |
| R195S | 1766 | 3191 | 1.0 | 138 | 1.0 |
| A79T, S99G, T185A, R195G, E200K, H202Q, L206F | 1767 | 1963 | 0.6 | 643 | 4.8 |
| K57R, S99G, L124S, K144Q | 1768 | 2081 | 0.7 | 14106 | 105.3 |
| K57R, S99G, R195G | 1769 | 2479 | 0.8 | 10955 | 81.8 |
| D55V, M97L, S99G | 1770 | 11907 | 3.8 | 71242 | 531.7 |
| E27G, I36T, D55N, M97L, K111E | 1771 | 1904 | 0.6 | 88724 | 662.1 |
| E54G, M97L, S99G | 1772 | 8414 | 2.7 | 51905 | 387.4 |
| G15A, I36T, M97L, K111E, H202Q | 1773 | 112 | 0.0 | 13530 | 101.0 |
| G15A, I36T, V129D | 1774 | 114 | 0.0 | 136 | 1.0 |
| G15A, I36T, V129D, R195G | 1775 | 125 | 0.0 | 134 | 1.0 |
| G15A, V129D | 1776 | 2075 | 0.7 | 128 | 1.0 |
| I36S, M97L | 1777 | 3459 | 1.1 | 44551 | 332.5 |
| I36T, D55N, M97L, K111E, A204T | 1778 | 265 | 0.1 | 62697 | 467.9 |
| I36T, D55N, M97L, K111E, V129A, F173L | 1779 | 393 | 0.1 | 72641 | 542.1 |
| I36T, D55S, M97L, K111E, I148V, R180S | 1780 | 94 | 0.0 | 30704 | 229.1 |
| I36T, G52R, M97L, V112A, K144E, V175A, P198T | 1781 | 81 | 0.0 | 149 | 1.1 |
| I36T, I46V, D55G, M97L, K106E, K144E, T185A, R195G | 1782 | 69 | 0.0 | 190 | 1.4 |
| I36T, I83T, M97L, K144E, P198T | 1783 | 62 | 0.0 | 6216 | 46.4 |
| I36T, M97L, K111E | 1784 | Little or no protein produced | | | |
| I36T, M97L, K144E, P198T | 1785 | 197 | 0.1 | 40989 | 305.9 |
| I36T, M97L, Q155H, F193S, N201Y | 1786 | 69 | 0.0 | 1251 | 9.3 |
| I36T, M97L, V129D | 1787 | 523 | 0.2 | 50905 | 379.9 |
| L35P, I36S, M97L, K111E | 1788 | 190 | 0.1 | 155 | 1.2 |
| M18I, I36T, E53G, M97L, K144E, E199G, V207A | 1789 | 104 | 0.0 | 47358 | 353.4 |
| M18T, I36T, D55N, M97L, K111E | 1790 | 138 | 0.0 | 71440 | 533.1 |
| M18V, M97L, T176N, R195G | 1791 | 1301 | 0.4 | 45300 | 338.1 |
| M97L, S99G | 1792 | 12906 | 4.1 | 81630 | 609.2 |
| N17D, M97L, S99G | 1793 | 10079 | 3.2 | 73249 | 546.6 |
| S99G, T185A, R195G, P198T | 1794 | 2606 | 0.8 | 22062 | 164.6 |
| V129D, H202Q | 1795 | 2001 | 0.6 | 219 | 1.6 |
| V129D, P198T | 1796 | 3245 | 1.0 | 152 | 1.1 |
| V129D, T150A | 1797 | 1941 | 0.6 | 142 | 1.1 |
| V93E, V129D | 1798 | 1221 | 0.4 | 150 | 1.1 |
| Y10F, M18V, S99G, Q138R, T203A | 1799 | 70 | 0.0 | 412 | 3.1 |
| WT PD-L1 (IgV + IgC) Fc | — | 3121 | 1.0 | 134 | 1.0 |
| CTLA4-Fc | — | 59 | N/A | 199670 | N/A |
| Anti-PD1 mAb | — | 31482 | N/A | 134 | N/A |
| Fc Control | 1155 | 59 | N/A | 132 | N/A |

TABLE 14C

Additional Affinity-Matured IgSF Domain-Containing Molecules

| PD-L1 Mutation(s) | SEQ ID NO (ECD) |
|---|---|
| N45D | 1800 |
| K160M, R195G | 1801 |
| N45D, K144E | 1802 |
| N45D, P198S | 1803 |
| N45D, P198T | 1804 |
| N45D, R195G | 1805 |
| N45D, R195S | 1806 |
| N45D, S131F | 1807 |
| N45D, V58D | 1808 |
| V129D, R195S | 1809 |
| I98T, F173Y, L196S | 1810 |
| N45D, E134G, L213P | 1811 |
| N45D, F173I, S177C | 1812 |
| N45D, I148V, R195G | 1813 |
| N45D, K111T, R195G | 1814 |
| N45D, N113Y, R195S | 1815 |
| N45D, N165Y, E170G | 1816 |
| N45D, Q89R, I98V | 1817 |
| N45D, S131F, P198S | 1818 |
| N45D, S75P, P198S | 1819 |
| N45D, V50A, R195T | 1820 |
| E27D, N45D, T183A, I188V | 1821 |
| F173Y, T183I, L196S, T203A | 1822 |
| K23N, N45D, S75P, N120S | 1823 |
| N45D, G102D, R194W, R195G | 1824 |

TABLE 14C-continued

Additional Affinity-Matured IgSF Domain-Containing Molecules

| PD-L1 Mutation(s) | SEQ ID NO (ECD) |
|---|---|
| N45D, G52V, Q121L, P198S | 1825 |
| N45D, I148V, R195G, N201D | 1826 |
| N45D, K111T, T183A, I188V | 1827 |
| N45D, Q89R, F189S, P198S | 1828 |
| N45D, S99G, C137R, V207A | 1829 |
| N45D, T163I, K167R, R195G | 1830 |
| N45D, T183A, T192S, R194G | 1831 |
| N45D, V50A, I119T, K144E | 1832 |
| T19A, N45D, K144E, R195G | 1833 |
| V11E, N45D, T130A, P198T | 1834 |
| V26A, N45D, T163I, T185A | 1835 |
| K23N, N45D, L124S, K167T, R195G | 1836 |
| K23N, N45D, Q73R, T163I | 1837 |
| K28E, N45D, W149R, S158G, P198T | 1838 |
| K28R, N45D, K57E, I98V, R195S | 1839 |
| K28R, N45D, V129D, T163N, R195T | 1840 |
| M41K, D43G, N45D, R64S, R195G | 1841 |
| M41K, D43G, N45D, R64S, S99G | 1842 |
| N45D, R68L, F173L, D197G, P198S | 1843 |
| N45D, V50A, I148V, R195G, N201D | 1844 |
| M41K, D43G, K44E, N45D, R195G, N201D | 1845 |
| N45D, V50A, L124S, K144E, L179P, R195G | 1846 |

TABLE 15A

Variant PD-L2 selected against PD-1. Molecule sequence and binding data.

| PD-L2 mutation(s) | SEQ ID NO (IgV) | Binding to Jurkat/PD-1 Cells | | Fortebio binding to PD-1-Fc Response Units |
|---|---|---|---|---|
| | | MFI at 50 nM | Fold increase over wildtype PD-L2 IgV-Fc | |
| H15Q | 667 | 15998 | 1.63 | 0.007 |
| N24D | 668 | 1414 | 0.14 | −0.039 |
| E44D | 669 | 2928 | 0.3 | −0.006 |
| V89D | 670 | 3361 | 0.34 | 0.005 |
| Q82R, V89D | 671 | 44977 | 4.57 | 1.111 |
| E59G, Q82R | 672 | 12667 | 1.29 | −0.028 |
| S39I, V89D | 673 | 26130 | 2.65 | 0.26 |
| S67L, V89D | 674 | 15991 | 1.62 | 0.608 |
| S67L, I85F | 675 | 529 | 0.05 | −0.005 |
| S67L, I86T | 676 | 6833 | 0.69 | 0.141 |
| H15Q, K65R | 677 | 13497 | 1.37 | −0.001 |
| H15Q, Q72H, V89D | 678 | 12629 | 1.28 | 0.718 |
| H15Q, S67L, R76G | 679 | 47201 | 4.8 | 0.418 |
| H15Q, R76G, I85F | 680 | 2941 | 0.3 | −0.038 |
| H15Q, T47A, Q82R | 681 | 65174 | 6.62 | 0.194 |
| H15Q, Q82R, V89D | 682 | 49652 | 5.04 | 1.198 |
| H15Q, C23S, I86T | 683 | 830 | 0.08 | −0.026 |
| H15Q, S39I, I86T | 684 | 1027 | 0.1 | 0.309 |
| H15Q, R76G, I85F | 685 | 1894 | 0.19 | −0.006 |
| E44D, V89D, W91R | 686 | 614 | 0.06 | −0.048 |
| I13V, S67L, V89D | 687 | 26200 | 2.66 | 1.42 |
| H15Q, S67L, I86T | 688 | 15952 | 1.62 | 0.988 |
| I13V, H15Q, S67L, I86T | 689 | 21570 | 2.19 | 1.391 |
| I13V, H15Q, E44D, V89D | 690 | 23958 | 2.43 | 1.399 |
| I13V, S39I, E44D, Q82R, V89D | 691 | 71423 | 7.26 | 0.697 |
| I13V, E44D, Q82R, V89D | 692 | 45191 | 4.59 | 1.283 |
| I13V, Q72H, R76G, I86T | 693 | 10429 | 1.06 | 0.733 |
| I13V, H15Q, R76G, I85F | 694 | 4736 | 0.48 | −0.04 |
| H15Q, S67L, R76G, I85F | 696 | 2869 | 0.29 | 0.025 |
| H15Q, S39I, R76G, V89D | 695 | Little or no protein produced | | |
| H15Q, T47A, Q72H, R76G, I86T | 697 | 32103 | 3.26 | 0.512 |
| H15Q, T47A, Q72H, R76G | 698 | 16500 | 1.68 | 0.327 |
| I13V, H15Q, T47A, Q72H, R76G | 699 | 73412 | 7.46 | 0.896 |
| H15Q, E44D, R76G, I85F | 700 | 2885 | 0.29 | −0.013 |

TABLE 15A-continued

Variant PD-L2 selected against PD-1. Molecule sequence and binding data.

| | | Binding to Jurkat/PD-1 Cells | | Fortebio |
|---|---|---|---|---|
| PD-L2 mutation(s) | SEQ ID NO (IgV) | MFI at 50 nM | Fold increase over wildtype PD-L2 IgV-Fc | binding to PD-1-Fc Response Units |
| H15Q, S39I, S67L, V89D | 701 | 45502 | 4.62 | 1.174 |
| H15Q, N32D, S67L, V89D | 702 | 25880 | 2.63 | 1.407 |
| N32D, S67L, V89D | 703 | 31753 | 3.23 | 1.155 |
| H15Q, S67L, Q72H, R76G, V89D | 704 | 40180 | 4.08 | 1.464 |
| H15Q, Q72H, Q74R, R76G, I86T | 705 | 4049 | 0.41 | 0.093 |
| G28V, Q72H, R76G, I86T | 706 | 5563 | 0.57 | 0.003 |
| I13V, H15Q, S39I, E44D, S67L | 707 | 63508 | 6.45 | 0.889 |
| E44D, S67L, Q72H, Q82R, V89D | 708 | 51467 | 5.23 | 1.061 |
| H15Q, V89D | 709 | 17672 | 1.8 | 0.31 |
| H15Q, T47A | 710 | 26578 | 2.7 | 0.016 |
| I13V, H15Q, Q82R | 711 | 76146 | 7.74 | 0.655 |
| I13V, H15Q, V89D | 712 | 28745 | 2.92 | 1.331 |
| I13V, S67L, Q82R, V89D | 713 | 58992 | 5.99 | 1.391 |
| I13V, H15Q, Q82R, V89D | 714 | 49523 | 5.03 | 1.419 |
| H15Q, V31M, S67L, Q82R, V89D | 715 | 67401 | 6.85 | 1.37 |
| I13V, H15Q, T47A, Q82R | 716 | 89126 | 9.05 | 0.652 |
| I13V, H15Q, V31A, N45S, Q82R, V89D | 717 | 68016 | 6.91 | 1.327 |
| H15Q, T47A, H69L, Q82R, V89D | 719 | 65598 | 6.66 | 1.44 |
| I13V, H15Q, T47A, H69L, R76G, V89D | 720 | 54340 | 5.52 | 1.719 |
| I12V, I13V, H15Q, T47A, Q82R, V89D | 721 | 61207 | 6.22 | 1.453 |
| I13V, H15Q, R76G, D77N, Q82R, V89D | 722 | 33079 | 3.36 | 0.065 |
| I13V, H15Q, T47A, R76G, V89D | 723 | 53668 | 5.45 | 1.596 |
| I13V, H15Q, T47A, Q82R, V89D | 724 | 63320 | 6.43 | 1.418 |
| I13V, H15Q, T47A, Q82R, V89D | 725 | 60980 | 6.2 | 1.448 |
| I13V, H15Q, I36V, T47A, S67L, V89D | 727 | 52835 | 5.37 | 1.627 |
| H15Q, T47A, K65R, S67L, Q82R, V89D | 728 | 79692 | 8.1 | 1.453 |
| H15Q, L33P, T47A, S67L, P71S, V89D | 729 | 45726 | 4.65 | 1.467 |
| I13V, H15Q, Q72H, R76G, I86T | 730 | 24450 | 2.48 | 1.355 |
| H15Q, T47A, S67L, Q82R, V89D | 731 | 67962 | 6.9 | 1.479 |
| F2L, H15Q, D46E, T47A, Q72H, R76G, Q82R, V89D | 732 | 23039 | 2.34 | 1.045 |
| I13V, H15Q, L33F, T47A, Q82R, V89D | 733 | 62254 | 6.32 | 1.379 |
| H15Q, N24S, T47A, Q72H, R76G, V89D | 735 | 32077 | 3.26 | 0.4 |
| I13V, H15Q, E44V, T47A, Q82R, V89D | 736 | 61005 | 6.2 | 1.329 |
| H15Q, N18D, T47A, Q72H, V73A, R76G, I86T, V89D | 737 | 48317 | 4.91 | 0.475 |
| I13V, H15Q, T37A, E44D, S48C, S67L, Q82R, V89D | 738 | 47605 | 4.84 | 1.255 |
| H15Q, L33H, S67L, R76G, Q82R, V89D | 739 | 62326 | 6.33 | 1.507 |
| I13V, H15Q, T47A, Q72H, R76G, I86T | 740 | 49016 | 4.98 | 1.477 |
| H15Q, S39I, E44D, Q72H, V75G, R76G, Q82R, V89D | 741 | 43713 | 4.44 | 0.646 |
| H15Q, T47A, S67L, R76G, Q82R, V89D | 742 | 71897 | 7.3 | 1.539 |
| I13V, H15Q, T47A, S67L, Q72H, R76G, Q82R, V89D | 743 | 71755 | 7.29 | 1.536 |
| Wild Type PD-L2 IgV | 726 | 9843 | 1 | −0.024 |
| Full length ECD of PD-L2 | 31 | 2145 | 0.22 | 0.071 |
| Full length ECD of PD-L1 (R&D Systems) | 30 | 23769 | 2.41 | 1.263 |
| Anti-PD-1 monoclonal antibody (nivolumab) | — | 87002 | 8.84 | 0.899 |

TABLE 15B

Bioactivity Data of PD-L2 variants selected against PD-1 in MLR.

| PD-L2 mutation(s) | SEQ ID NO (IgV) | IFN gamma levels pg/ml | Fold increase over wildtype PD-L2 IgV-Fc |
|---|---|---|---|
| H15Q | 667 | 1817.1 | 1.32 |
| N24D | 668 | 1976.3 | 1.44 |
| E44D | 669 | 1499.4 | 1.09 |
| V89D | 670 | 1168.1 | 0.85 |
| Q82R, V89D | 671 | 1617 | 1.17 |
| E59Q, Q82R | 672 | 1511.3 | 1.1 |
| S39I, V89D | 673 | 1314.5 | 0.95 |
| S67L, V89D | 674 | 1230.1 | 0.89 |
| S67L, I85F | 675 | 1281.9 | 0.93 |
| S67L, I86T | 676 | 1020.4 | 0.74 |
| H15Q, K65R | 677 | 1510.8 | 1.1 |

TABLE 15B-continued

Bioactivity Data of PD-L2 variants selected against PD-1 in MLR.

| PD-L2 mutation(s) | SEQ ID NO (IgV) | IFN gamma levels pg/ml | Fold increase over wildtype PD-L2 IgV-Fc |
|---|---|---|---|
| H15Q, Q72H, V89D | 678 | 1272.2 | 0.92 |
| H15Q, S67L, R76G | 679 | 1426.2 | 1.04 |
| H15Q, R76G, I85F | 680 | 1725.7 | 1.25 |
| H15Q, T47A, Q82R | 681 | 1317.9 | 0.96 |
| H15Q, Q82R, V89D | 682 | 1081.2 | 0.79 |
| H15Q, C23S, I86T | 683 | 1847.2 | 1.34 |
| H15Q, S39I, I86T | 684 | 1415.2 | 1.03 |
| H15Q, R76G, I85F | 685 | 1437.8 | 1.04 |
| E44D, V89D, W91R | 686 | 1560.1 | 1.13 |
| I13V, S67L, V89D | 687 | 867.5 | 0.63 |
| H15Q, S67L, I86T | 688 | 1034.2 | 0.75 |

TABLE 15B-continued

Bioactivity Data of PD-L2 variants selected against PD-1 in MLR.

| PD-L2 mutation(s) | SEQ ID NO (IgV) | IFN gamma levels pg/ml | Fold increase over wildtype PD-L2 IgV-Fc |
|---|---|---|---|
| I13V, H15Q, S67L, I86T | 689 | 1014.4 | 0.74 |
| I13V, H15Q, E44D, V89D | 690 | 1384.2 | 1.01 |
| I13V, S39I, E44D, Q82R, V89D | 691 | 935.6 | 0.68 |
| I13V, E44D, Q82R, V89D | 692 | 1009.5 | 0.73 |
| I13V, Q72H, R76G, I86T | 693 | 1953 | 1.42 |
| I13V, H15Q, R76G, I85F | 694 | 1528.5 | 1.11 |
| H15Q, S67L, R76G, I85F | 696 | 1318.7 | 0.96 |
| H15Q, T47A, Q72H, R76G, I86T | 697 | 1599.6 | 1.16 |
| H15Q, T47A, Q72H, R76G | 698 | 1462.5 | 1.06 |
| I13V, H15Q, T47A, Q72H, R76G | 699 | 1469.8 | 1.07 |
| H15Q, E44D, R76G, I85F | 700 | 1391.6 | 1.01 |
| H15Q, S39I, S67L, V89D | 701 | 1227 | 0.89 |
| H15Q, N32D, S67L, V89D | 702 | 1285.7 | 0.93 |
| N32D, S67L, V89D | 703 | 1194 | 0.87 |
| H15Q, S67L, Q72H, R76G, V89D | 704 | 1061.2 | 0.77 |
| H15Q, Q72H, Q74R, R76G, I86T | 705 | 933.8 | 0.68 |
| G28V, Q72H, R76G, I86T | 706 | 1781.6 | 1.29 |
| I13V, H15Q, S39I, E44D, S67L | 707 | 1256.9 | 0.91 |
| E44D, S67L, Q72H, Q82R, V89D | 708 | 1281.4 | 0.93 |
| H15Q, V89D | 709 | 1495.4 | 1.09 |
| H15Q, T47A | 710 | 1637.2 | 1.19 |
| I13V, H15Q, Q82R | 711 | 1432.9 | 1.04 |
| I13V, H15Q, V89D | 712 | 1123 | 0.82 |
| I13V, S67L, Q82R, V89D | 713 | 1372.8 | 1 |
| I13V, H15Q, Q82R, V89D | 714 | 1596.6 | 1.16 |
| H15Q, V31M, S67L, Q82R, V89D | 715 | 1206.5 | 0.88 |
| I13V, H15Q, T47A, Q82R | 716 | 1703.3 | 1.24 |
| I13V, H15Q, V31A, N45S, Q82R, V89D | 717 | 1723.1 | 1.25 |
| H15Q, T47A, H69L, Q82R, V89D | 719 | 1732.5 | 1.26 |
| I13V, H15Q, T47A, H69L, R76G, V89D | 720 | 1075.5 | 0.78 |
| I12V, I13V, H15Q, T47A, Q82R, V89D | 721 | 1533.2 | 1.11 |
| I13V, H15Q, R76G, D77N, Q82R, V89D | 722 | 1187.9 | 0.86 |

TABLE 15B-continued

Bioactivity Data of PD-L2 variants selected against PD-1 in MLR.

| PD-L2 mutation(s) | SEQ ID NO (IgV) | IFN gamma levels pg/ml | Fold increase over wildtype PD-L2 IgV-Fc |
|---|---|---|---|
| I13V, H15Q, T47A, R76G, V89D | 723 | 1253.7 | 0.91 |
| I13V, H15Q, T47A, Q82R, V89D | 724 | 1445.5 | 1.05 |
| I13V, H15Q, T47A, Q82R, V89D | 725 | 1737 | 1.26 |
| I13V, H15Q, I36V, T47A, S67L, V89D | 727 | 1357.4 | 0.99 |
| H15Q, T47A, K65R, S67L, Q82R, V89D | 728 | 1335.3 | 0.97 |
| H15Q, L33P, T47A, S67L, P71S, V89D | 729 | 1289.1 | 0.94 |
| I13V, H15Q, Q72H, R76G, I86T | 730 | 1221 | 0.89 |
| H15Q, T47A, S67L, Q82R, V89D | 731 | 1197.1 | 0.87 |
| F2L, H15Q, D46E, T47A, Q72H, R76G, Q82R, V89D | 737 | 1170.7 | 0.85 |
| I13V, H15Q, L33F, T47A, Q82R, V89D | 733 | 1468.4 | 1.07 |
| I13V, H15Q, T47A, E58G, S67L, Q82R, V89D | 734 | 836.1 | 0.61 |
| H15Q, N24S, T47A, Q72H, R76G, V89D | 735 | 1091.8 | 0.79 |
| I13V, H15Q, E44V, T47A, Q82R, V89D | 736 | 1270.5 | 0.92 |
| H15Q, N18D, T47A, Q72H, V73A, R76G, I86T, V89D | 737 | 1065.8 | 0.77 |
| I13V, H15Q, T37A, E44D, S48C, S67L, Q82R, V89D | 738 | 1751.7 | 1.27 |
| H15Q, L33H, S67L, R76G, Q82R, V89D | 739 | 1502 | 1.09 |
| I13V, H15Q, T47A, Q72H, R76G, I86T | 740 | 1088.1 | 0.79 |
| H15Q, S39I, E44D, Q72H, V75G, R76G, Q82R, V89D | 741 | 940.9 | 0.68 |
| H15Q, T47A, S67L, R76G, Q82R, V89D | 742 | 1097.8 | 0.8 |
| I13V, H15Q, T47A, S67L, Q72H, R76G, Q82R, V89D | 743 | 1559.6 | 1.13 |
| Wild Type PD-L2 IgV | 726 | 1376.8 | 1 |
| Full length ECD of PD-L2 | 31 | 1173.2 | 0.85 |
| Full length ECD of PD-L1 | 30 | 2190.9 | 1.59 |
| Nivolumab (anti-PD-1) | — | 418.9 | 0.3 |

TABLE 16A

Variant CD112 selected against cognate binding partners. Molecule sequences, binding data, and costimulatory bioactivity data.

| CD112 mutation(s) | SEQ ID NO (IgV) | TIGIT tfxn MFI (TIGIT MFI parental ratio) | CD112R tfxn MFI (CD112R MFI parental ratio) | CD226 MFI (CD226 MFI parental ratio) | Mock Expi293 MFI (Mock MFI parental ratio) | Anti-CD3 IFN-gamma (pg/ml) (Anti-CD3 IFN-gamma parental ratio) |
|---|---|---|---|---|---|---|
| WT CD112 | 1367 | 210829 (1.00) | 1452 (1.00) | 265392 (1.00) | 1112 (1.00) | 676.6 (1.00) |
| Y33H, A112V, G117D | 1368 | 12948 (0.06) | 1552 (1.07) | 1368 (0.01) | 1241 (1.12) | 164.8 (0.24) |
| V19A, Y33H, S64G, S80G, G98S, N106Y, A112V | 1369 | 48356 (0.23) | 1709 (1.18) | 2831 (0.01) | 1098 (0.99) | |
| L32P, A112V | 1370 | 191432 (0.91) | 1557 (1.07) | 11095 (0.04) | 1259 (1.13) | 390.4 (0.58) |
| A95V, A112I | 1371 | 238418 (1.13) | 1706 (1.17) | 51944 (0.20) | 1215 (1.09) | 282.5 (0.42) |
| P28S, A112V | 1372 | 251116 (1.19) | 1985 (1.37) | 153382 (0.58) | 1189 (1.07) | 503.4 (0.74) |
| P27A, T38N, V101A, A112V | 1373 | 255803 (1.21) | 2138 (1.47) | 222822 (0.84) | 1399 (1.26) | 240.7 (0.36) |
| S118F | 1374 | 11356 (0.05) | 5857 (4.03) | 6938 (0.03) | 1270 (1.14) | 271.7 (0.40) |
| R12W, H48Y, F54S, S118F | 1375 | 10940 (0.05) | 3474 (2.39) | 5161 (0.02) | 1069 (0.96) | |
| R12W, Q79R, S118F | 1376 | 2339 (0.01) | 7370 (5.08) | 1880 (0.01) | 1338 (1.20) | 447.4 (0.66) |
| T113S, S118Y | 1377 | 6212 (0.03) | 6823 (4.70) | 1554 (0.01) | 1214 (1.09) | 225.1 (0.33) |

TABLE 16A-continued

Variant CD112 selected against cognate binding partners. Molecule
sequences, binding data, and costimulatory bioactivity data.

| CD112 mutation(s) | SEQ ID NO (IgV) | TIGIT tfxn MFI (TIGIT MFI parental ratio) | CD112R tfxn MFI (CD112R MFI parental ratio) | CD226 MFI (CD226 MFI parental ratio) | Mock Expi293 MFI (Mock MFI parental ratio) | Anti-CD3 IFN-gamma (pg/ml) (Anti-CD3 IFN-gamma parental ratio) |
|---|---|---|---|---|---|---|
| S118Y | 1378 | 2921 (0.01) | 6535 (4.50) | 2003 (0.01) | 1463 (1.32) | 190.4 (0.28) |
| N106I, S118Y | 1379 | 2750 (0.01) | 7729 (5.32) | 1815 (0.01) | 1222 (1.10) | 265.8 (0.39) |
| N106I, S118F | 1380 | 1841 (0.01) | 9944 (6.85) | 1529 (0.01) | 1308 (1.18) | 437.9 (0.65) |
| A95T, L96P, S118Y | 1381 | 2352 (0.01) | 4493 (3.09) | 1412 (0.01) | 1329 (1.19) | 292.4 (0.43) |
| Y33H, P67S, N106Y, A112V | 1382 | 225015 (1.07) | 3259 (2.24) | 204434 (0.77) | 1296 (1.17) | 618.8 (0.91) |
| N106Y, A112V | 1383 | 6036 (0.03) | 1974 (1.36) | 15334 (0.06) | 1108 (1.00) | 409.9 (0.61) |
| T18S, Y33H, A112V | 1384 | 252647 (1.20) | 1347 (0.93) | 183181 (0.69) | 1412 (1.27) | 601.8 (0.89) |
| P9S, Y33H, N47S, A112V | 1385 | 240467 (1.14) | 1418 (0.98) | 203608 (0.77) | 1361 (1.22) | 449.1 (0.66) |
| P42S, P67H, A112V | 1386 | 204484 (0.97) | 1610 (1.11) | 188647 (0.71) | 1174 (1.06) | 530.6 (0.78) |
| P27L, L32P, P42S, A112V | 1387 | 219883 (1.04) | 1963 (1.35) | 84319 (0.32) | 1900 (1.71) | 251.6 (0.37) |
| G98D, A112V | 1388 | 4879 (0.02) | 2369 (1.63) | 6100 (0.02) | 1729 (1.55) | 387.0 (0.57) |
| Y33H, S35P, N106Y, A112V | 1389 | 250724 (1.19) | 1715 (1.18) | 94373 (0.36) | 1495 (1.34) | 516.2 (0.76) |
| L32P, P42S, T100A, A112V | 1390 | 242675 (1.15) | 1742 (1.20) | 202567 (0.76) | 1748 (1.57) | 435.3 (0.64) |
| P27S, P45S, N106I, A112V | 1391 | 223557 (1.06) | 1799 (1.24) | 84836 (0.32) | 1574 (1.42) | 277.5 (0.41) |
| Y33H, N47K, A112V | 1392 | 251339 (1.19) | 1525 (1.05) | 199601 (0.75) | 1325 (1.19) | 483.2 (0.71) |
| Y33H, N106Y, A112V | 1393 | 297169 (1.41) | 1782 (1.23) | 258315 (0.97) | 1440 (1.30) | 485.4 (0.72) |
| K78R, D84G, A112V, F114S | 1394 | 236662 (1.12) | 1638 (1.13) | 24850 (0.09) | 1345 (1.21) | 142.5 (0.21) |
| Y33H, N47K, F54L, A112V | 1395 | 14483 (0.07) | 1617 (1.11) | 2371 (0.01) | 1353 (1.22) | 352.8 (0.52) |
| Y33H, A112V | 1396 | 98954 (0.47) | 1216 (0.84) | 1726 (0.01) | 1298 (1.17) | |
| A95V, A112V | 1397 | 168521 (0.80) | 2021 (1.39) | 200789 (0.76) | 1459 (1.31) | 412.9 (0.61) |
| R12W, A112V | 1398 | 135635 (0.64) | 1582 (1.09) | 23378 (0.09) | 1412 (1.27) | 165.8 (0.24) |
| A112V | 1404 | 213576 (1.01) | 1986 (1.37) | 151900 (0.57) | 1409 (1.27) | 211.4 (0.31) |
| Y33H, A112V | 1396 | 250667 (1.19) | 1628 (1.12) | 230578 (0.87) | 1216 (1.09) | 612.7 (0.91) |
| R12W, P27S, A112V | 1399 | 3653 (0.02) | 1308 (0.90) | 9105 (0.03) | 1051 (0.94) | |
| Y33H, V51M, A112V | 1400 | 218698 (1.04) | 1384 (0.95) | 195450 (0.74) | 1170 (1.05) | 709.4 (1.05) |
| Y33H, A112V, S118T | 1401 | 219384 (1.04) | 1566 (1.08) | 192645 (0.73) | 1313 (1.18) | 396.3 (0.59) |
| Y33H, V101A, A112V, P115S | 1402 | 5605 (0.03) | 1582 (1.09) | 5079 (0.02) | 1197 (1.08) | |
| H24R, T38N, D43G, A112V | 1403 | 227095 (1.08) | 1537 (1.06) | 229311 (0.86) | 1336 (1.20) | 858.6 (1.27) |
| A112V | 1404 | 4056 (0.02) | 1356 (0.93) | 10365 (0.04) | 986 (0.89) | |
| P27A, A112V | 1405 | 193537 (0.92) | 1531 (1.05) | 230708 (0.87) | 3084 (2.77) | 355.1 (0.52) |
| A112V, S118T | 1406 | 233173 (1.11) | 1659 (1.14) | 121817 (0.46) | 845 (0.76) | 533.3 (0.79) |
| R12W, A112V, M122I | 1407 | 235935 (1.12) | 1463 (1.01) | 217748 (0.82) | 1350 (1.21) | 528.0 (0.78) |
| Q83K, N106Y, A112V | 1408 | 205948 (0.98) | 2042 (1.41) | 234958 (0.89) | 1551 (1.39) | 481.4 (0.71) |
| R12W, P27S, A112V, S118T | 1409 | 11985 (0.06) | 2667 (1.84) | 12756 (0.05) | 1257 (1.13) | 334.4 (0.49) |

TABLE 16A-continued

Variant CD112 selected against cognate binding partners. Molecule
sequences, binding data, and costimulatory bioactivity data.

| CD112 mutation(s) | SEQ ID NO (IgV) | TIGIT tfxn MFI (TIGIT MFI parental ratio) | CD112R tfxn MFI (CD112R MFI parental ratio) | CD226 MFI (CD226 MFI parental ratio) | Mock Expi293 MFI (Mock MFI parental ratio) | Anti-CD3 IFN-gamma (pg/ml) (Anti-CD3 IFN-gamma parental ratio) |
|---|---|---|---|---|---|---|
| P28S, Y33H, A112V | 1410 | 4711 (0.02) | 1412 (0.97) | 3968 (0.01) | 955 (0.86) | |
| P27S, Q90R, A112V | 1411 | 3295 (0.02) | 1338 (0.92) | 6755 (0.03) | 1048 (0.94) | |
| L15V, P27A, A112V, S118T | 1412 | 209888 (1.00) | 1489 (1.03) | 84224 (0.32) | 1251 (1.13) | 512.3 0.76) |
| Y33H, N106Y, T108I, A112V | 1413 | | | Not tested | | |
| Y33H, P56L, V75M, V101M, A112V | 1414 | | | Not tested | | |

TABLE 16B

Additional CD112 Variants and Binding Data.

| CD112 Mutation(s) | SEQ ID NO (IgV) | TIGIT MFI 100 nM | TIGIT Fold Increase to WT IgV | CD226 MFI at 100 nM | CD226 Fold Increase to WT IgV | CD112R MFI at 100 nM | CD112R Fold Increase to WT IgV | CD96 MFI at 100 nM | CD96 Fold Increase to WT IgV |
|---|---|---|---|---|---|---|---|---|---|
| S118F | 1374 | 1763 | 0.02 | 1645 | 0.08 | 2974 | 0.61 | 1659 | 0.19 |
| N47K, Q79R, S118F | 1497 | 1738 | 0.02 | 1689 | 0.09 | 2637 | 0.54 | 1647 | 0.19 |
| Q40R, P60T, A112V, S118T | 1498 | 4980 | 0.06 | 1608 | 0.08 | 2399 | 0.50 | 2724 | 0.32 |
| F114Y, S118F | 1499 | 110506 | 1.34 | 7325 | 0.37 | 1502 | 0.31 | 1553 | 0.18 |
| N106I, S118Y | 1379 | 1981 | 0.02 | 1700 | 0.09 | 2394 | 0.49 | 1582 | 0.19 |
| S118Y | 1378 | 101296 | 1.23 | 9990 | 0.50 | 1429 | 0.30 | 1551 | 0.18 |
| Y33H, K78R, S118Y | 1500 | 2276 | 0.03 | 2115 | 0.11 | 3429 | 0.71 | 2082 | 0.24 |
| N106I, S118F | 1380 | 1875 | 0.02 | 1675 | 0.08 | 2365 | 0.49 | 1662 | 0.19 |
| R12W, A46T, K66M, Q79R, N106I, T113A, S118F | 1501 | 3357 | 0.04 | 1808 | 0.09 | 1664 | 0.34 | 4057 | 0.48 |
| Y33H, A112V, S118F | 1502 | 3376 | 0.04 | 2886 | 0.15 | 3574 | 0.74 | 3685 | 0.43 |
| R12W, Y33H, N106I, S118F | 1503 | 100624 | 1.22 | 24513 | 1.24 | 1490 | 0.31 | 2060 | 0.24 |
| L15V, Q90R, S118F | 1504 | 5791 | 0.07 | 4169 | 0.21 | 2752 | 0.57 | 4458 | 0.52 |
| N47K, D84G, N106I, S118Y | 1505 | 3334 | 0.04 | 2819 | 0.14 | 2528 | 0.52 | 3498 | 0.41 |
| L32P, S118F | 1506 | 3881 | 0.05 | 2506 | 0.13 | 2659 | 0.55 | 2518 | 0.29 |
| Y33H, Q79R, A112V, S118Y | 1507 | | | Low to no protein produced | | | | | |
| T18A, N106I, S118T | 1508 | 84035 | 1.02 | 10208 | 0.52 | 1585 | 0.33 | 1590 | 0.19 |
| L15V, Y33H, N106Y, A112V, S118F | 1509 | | | Low to no protein produced | | | | | |
| V37M, S118F | 1510 | 96986 | 1.18 | 2523 | 0.13 | 1985 | 0.41 | 1849 | 0.22 |
| N47K, A112V, S118Y | 1511 | 1980 | 0.02 | 1859 | 0.09 | 2733 | 0.56 | 1825 | 0.21 |
| A46T, A112V | 1512 | 4224 | 0.05 | 4685 | 0.24 | 3288 | 0.68 | 4273 | 0.50 |
| P28S, Y33H, N106I, S118Y | 1513 | 6094 | 0.07 | 2181 | 0.11 | 1891 | 0.39 | 3021 | 0.35 |
| P30S, Y33H, N47K, V75M, Q79R, N106I, S118Y | 1514 | 2247 | 0.03 | 2044 | 0.10 | 1796 | 0.37 | 2658 | 0.31 |
| V19A, N47K, N106Y, K116E, S118Y | 1515 | 2504 | 0.03 | 2395 | 0.12 | 2174 | 0.45 | 2852 | 0.33 |
| Q79R, T85A, A112V, S118Y | 1516 | 2192 | 0.03 | 1741 | 0.09 | 2367 | 0.49 | 1620 | 0.19 |
| Y33H, A112V | 1396 | 20646 | 0.25 | 1465 | 0.07 | 1794 | 0.37 | 2589 | 0.30 |
| V101M, N106I, S118Y | 1517 | 55274 | 0.67 | 6625 | 0.33 | 1357 | 0.28 | 1494 | 0.17 |
| Y33H, Q79R, N106I, A112V, S118T | 1518 | 6095 | 0.07 | 1760 | 0.09 | 2393 | 0.49 | 3033 | 0.36 |
| Q79R, A112V | 1519 | 1571 | 0.02 | 1490 | 0.08 | 2284 | 0.47 | 1326 | 0.16 |
| Y33H, A46T, Q79R, N106I, S118F | 1520 | 90813 | 1.10 | 15626 | 0.79 | 1298 | 0.27 | 3571 | 0.42 |
| A112V, G121S | 1521 | 95674 | 1.16 | 19992 | 1.01 | 1252 | 0.26 | 4005 | 0.47 |
| Y33H, Q79R, N106I, S118Y | 1522 | 36246 | 0.44 | 2118 | 0.11 | 1970 | 0.41 | 3250 | 0.38 |

TABLE 16B-continued

Additional CD112 Variants and Binding Data.

| | | TIGIT | | CD226 | | CD112R | | CD96 | |
|---|---|---|---|---|---|---|---|---|---|
| CD112 Mutation(s) | SEQ ID NO (IgV) | MFI 100 nM | Fold Increase to WT IgV | MFI at 100 nM | Fold Increase to WT IgV | MFI at 100 nM | Fold Increase to WT IgV | MFI at 100 nM | Fold Increase to WT IgV |
| Y33H, N106I, A112V | 1523 | 47352 | 0.57 | 4217 | 0.21 | 2641 | 0.55 | 1488 | 0.17 |
| Y33H, A46T, V101M, A112V, S118T | 1524 | 14413 | 0.17 | 1596 | 0.08 | 2335 | 0.48 | 1441 | 0.17 |
| L32P, L99M, N106I, S118F | 1525 | 3056 | 0.04 | 1791 | 0.09 | 2210 | 0.46 | 2000 | 0.23 |
| L32P, T108A, S118F | 1526 | 104685 | 1.27 | 4531 | 0.23 | 2308 | 0.48 | 1518 | 0.18 |
| A112V | 1404 | 4937 | 0.06 | 1903 | 0.10 | 1646 | 0.34 | 3011 | 0.35 |
| R12W, Q79R, A112V | 1527 | 55539 | 0.67 | 6918 | 0.35 | 1386 | 0.29 | 1740 | 0.20 |
| Y33H, N106Y, E110G, A112V | 1528 | 2786 | 0.03 | 2517 | 0.13 | 1787 | 0.37 | 2023 | 0.24 |
| Y33H, N106I, S118Y | 1529 | 1967 | 0.02 | 1579 | 0.08 | 2601 | 0.54 | 1517 | 0.18 |
| Q79R, S118F | 1530 | 82055 | 1.00 | 7582 | 0.38 | 1298 | 0.27 | 1970 | 0.23 |
| Y33H, Q79R, G98D, V101M, A112V | 1531 | 21940 | 0.27 | 1632 | 0.08 | 1141 | 0.24 | 18423 | 2.16 |
| N47K, T81S, V101M, A112V, S118F | 1532 | 6889 | 0.08 | 1311 | 0.07 | 1303 | 0.27 | 1145 | 0.13 |
| G82S, S118Y | 1533 | 4267 | 0.05 | 1938 | 0.10 | 2140 | 0.44 | 2812 | 0.33 |
| Y33H, A112V, S118Y | 1534 | 14450 | 0.18 | 1532 | 0.08 | 2353 | 0.49 | 3004 | 0.35 |
| Y33H, N47K, Q79R, N106Y, A112V | 1535 | 70440 | 0.85 | 3557 | 0.18 | 1447 | 0.30 | 1679 | 0.20 |
| Y33H, S118T | 1536 | 113896 | 1.38 | 17724 | 0.89 | 1252 | 0.26 | 5001 | 0.59 |
| R12W, Y33H, Q79R, V101M, A112V | 1537 | 3376 | 0.04 | 2727 | 0.14 | 2047 | 0.42 | 2339 | 0.27 |
| S118F | 1374 | 2685 | 0.03 | 1864 | 0.09 | 2520 | 0.52 | 1566 | 0.18 |
| Wildtype CD112-IgV Fc | 1367 (IgV) | 82414 | 1.00 | 19803 | 1.00 | 4842 | 1.00 | 8541 | 1.00 |
| CD112 ECD-Fc | 48 (ECD) | 29157 | 0.35 | 8755 | 0.44 | 1107 | 0.23 | 1103 | 0.13 |
| Anti-hFc PE | — | 1383 | 0.02 | 1461 | 0.07 | 1358 | 0.28 | 1468 | 0.17 |

TABLE 16C

Additional CD112 Variants and Binding Data.

| | | TIGIT | | CD226 | | CD112R | | CD96 | |
|---|---|---|---|---|---|---|---|---|---|
| CD112 Mutation(s) | SEQ ID NO (IgV) | MFI 20 nM | Fold Increase to WT IgV | MFI at 20 nM | Fold Increase to WT IgV | MFI at 20 nM | Fold Increase to WT IgV | MFI at 20 nM | Fold Increase to WT IgV |
| N106I, S118Y | 1379 | 1288 | 0.04 | 1334 | 0.12 | 6920 | 4.16 | 1102 | 0.44 |
| Y33H, Q83K, A112V, S118T | 1586 | 115690 | 3.31 | 10046 | 0.93 | 1128 | 0.68 | 2053 | 0.82 |
| R12W, Q79R, S118F | 1376 | 1436 | 0.04 | 1296 | 0.12 | 6546 | 3.93 | 1046 | 0.42 |
| V29M, Y33H, N106I, S118F | 1587 | | | | Not tested | | | | |
| Y33H, A46T, A112V | 1588 | 111256 | 3.18 | 14974 | 1.39 | 1148 | 0.69 | 3333 | 1.34 |
| Y33H, Q79R, S118F | 1589 | 1483 | 0.04 | 1326 | 0.12 | 7425 | 4.46 | 1138 | 0.46 |
| Y33H, N47K, F74L, S118F | 1590 | 1338 | 0.04 | 1159 | 0.11 | 1516 | 0.91 | 1140 | 0.46 |
| R12W, V101M, N106I, S118Y | 1591 | 1378 | 0.04 | 1249 | 0.12 | 5980 | 3.59 | 1182 | 0.47 |
| A46T, V101A, N106I, S118Y | 1592 | 1359 | 0.04 | 1199 | 0.11 | 6729 | 4.04 | 1173 | 0.47 |
| Y33H, N106Y, A112V | 1393 | 113580 | 3.25 | 17771 | 1.65 | 1207 | 0.72 | 2476 | 0.99 |
| N106Y, A112V, S118T | 1593 | | | | Not tested | | | | |
| S76P, T81I, V101M, N106Y, A112V, S118F | 1594 | | | | Not tested | | | | |
| N106Y, A112V | 1383 | 29015 | 0.83 | 2760 | 0.26 | 1159 | 0.70 | 1639 | 0.66 |
| P9R, L21V, P22L, I34M, S69F, F74L, A87V, A112V, L125A | 1595 | 1920 | 0.05 | 1218 | 0.11 | 1107 | 0.66 | 1074 | 0.43 |
| Y33H, V101M, A112V | 1596 | 126266 | 3.61 | 24408 | 2.27 | 1150 | 0.69 | 4535 | 1.82 |
| N106I, S118F | 1380 | 1776 | 0.05 | 1385 | 0.13 | 9058 | 5.44 | 1370 | 0.55 |
| V29A, L32P, S118F | 1597 | 1265 | 0.04 | 1148 | 0.11 | 5057 | 3.04 | 1194 | 0.48 |
| A112V | 1404 | 69673 | 1.99 | 6387 | 0.59 | 1140 | 0.68 | 1214 | 0.49 |
| Y33H, V101M, A112V | 1596 | 133815 | 3.83 | 24992 | 2.32 | 1184 | 0.71 | 6338 | 2.54 |
| P28S, Y33H, N106I, S118Y | 1513 | 2745 | 0.08 | 1689 | 0.16 | 6625 | 3.98 | 1978 | 0.79 |

TABLE 16C-continued

Additional CD112 Variants and Binding Data.

| | | TIGIT | | CD226 | | CD112R | | CD96 | |
|---|---|---|---|---|---|---|---|---|---|
| CD112 Mutation(s) | SEQ ID NO (IgV) | MFI 20 nM | Fold Increase to WT IgV | MFI at 20 nM | Fold Increase to WT IgV | MFI at 20 nM | Fold Increase to WT IgV | MFI at 20 nM | Fold Increase to WT IgV |
| Y33H, V101M, N106I, A112V | 1598 | 118654 | 3.40 | 21828 | 2.03 | 1253 | 0.75 | 3871 | 1.55 |
| R12W, Y33H, N47K, Q79R, S118Y | 1599 | 171390 | 4.91 | 5077 | 0.47 | 1124 | 0.68 | 2636 | 1.06 |
| A112V, S118T | 1406 | 103203 | 2.95 | 15076 | 1.40 | 1155 | 0.69 | 1426 | 0.57 |
| Y33H, A46T, A112V, S118T | 1600 | 141859 | 4.06 | 29436 | 2.74 | 1184 | 0.71 | 5760 | 2.31 |
| Y33H, A112V, F114L, S118T | 1601 | 5161 | 0.15 | 1734 | 0.16 | 1184 | 0.71 | 1249 | 0.50 |
| A112V | 1404 | 78902 | 2.26 | 6224 | 0.58 | 1114 | 0.67 | 1181 | 0.47 |
| Y33H, T38A, A46T, V101M, A112V | 1602 | 111293 | 3.19 | 25702 | 2.39 | 1192 | 0.72 | 99015 | 39.69 |
| Q79R, A112V | 1519 | 96674 | 2.77 | 7264 | 0.67 | 1130 | 0.68 | 1216 | 0.49 |
| Y33H, N106I, S118Y | 1529 | 5720 | 0.16 | 1453 | 0.14 | 6543 | 3.93 | 1248 | 0.50 |
| P28S, Y33H, S69P, N106I, A112V, S118Y | 1603 | 22393 | 0.64 | 1378 | 0.13 | 1550 | 0.93 | 19174 | 7.68 |
| Y33H, P42L, N47K, V101M, A112V | 1604 | 214116 | 6.13 | 13878 | 1.29 | 1315 | 0.79 | 4753 | 1.91 |
| Y33H, N47K, F74S, Q83K, N106I, F111L, A112V, S118T | 1605 | 6719 | 0.19 | 1319 | 0.12 | 1305 | 0.78 | 1278 | 0.51 |
| Y33H, A112V, S118T, V119A | 1606 | 184794 | 5.29 | 10204 | 0.95 | 1269 | 0.76 | 4321 | 1.73 |
| Y33H, N106I, A112V, S118F | 1607 | 6872 | 0.20 | 1591 | 0.15 | 2308 | 1.39 | 2796 | 1.12 |
| Y33H, K66M, S118F, W124L | 1608 | 1724 | 0.05 | 1259 | 0.12 | 6782 | 4.07 | 1197 | 0.48 |
| S118F | 1374 | 1325 | 0.04 | 1213 | 0.11 | 7029 | 4.22 | 1135 | 0.46 |
| N106I, A112V | 1609 | 111342 | 3.19 | 4241 | 0.39 | 1546 | 0.93 | 1178 | 0.47 |
| Y33H, A112V | 1396 | 177926 | 5.09 | 13761 | 1.28 | 1152 | 0.69 | 3117 | 1.25 |
| WT CD112 IgV | 1367 | 34932 | 1.00 | 10762 | 1.00 | 1665 | 1.00 | 2495 | 1.00 |
| WT CD112-Fc ECD | 48 (ECD) | 28277 | 0.81 | 8023 | 0.75 | 1253 | 0.75 | 1064 | 0.43 |
| Anti-huFc PE | — | 1138 | 0.03 | 1006 | 0.09 | 1010 | 0.61 | 1062 | 0.43 |

Example 11

Generation of Stacked Molecules Containing Different Affinity-Modified Domains

This Example describes further immunomodulatory proteins that were generated as multi-domain stack constructs containing at least two different affinity modified IgV domains from identified variant PD-L2 polypeptides and identified variant CD155 polypeptides described above. Specifically, the exemplary variant PD-L2 IgV H15Q/T47A/K65R/S67L/Q82R/V89D (SEQ ID NO:880) and the exemplary variant CD155 IgV molecule P18S/S65W/S67A/L104Q/G111R (SEQ ID NO:1271) were linked together and fused to an Fc in various configurations. Stack constructs were obtained as geneblocks (Integrated DNA Technologies, Coralville, IA) that either encoded the entire chain or they were generated by obtaining geneblocks that encoded PDL2-CD155 in its various configurations for subsequent Gibson assembly into Fc fusion vector using a Gibson assembly kit (New England Biolabs). Homodimeric and heterodimeric stacks were generated in various configurations as summarized in FIG. 5A and as follows.

Homodimeric stack constructs were generated containing identical Fc subunits in which the variant PD-L2 IgV and variant CD155 IgV were variously linked to the N- or C-terminus of a human IgG1 Fc region via a 2×GGGS (SEQ ID NO:1182) or 3×GGGGS (SEQ ID NO: 1181) peptide linker. In this study, the exemplary IgG1 Fc region is set forth in SEQ ID NO:1119 and contained the mutations L234A, L235E, G237A, E356D and M358L by EU numbering (corresponding to L19A, L20E, G22A, E141D and M143L with reference to wild-type human IgG1 Fc set forth in SEQ ID NO:56). Further, the Fc region contained replacement of the cysteine residues to a serine residue at position 5 (C5S) compared to the wild-type or unmodified Fc set forth in SEQ ID NO: 56 (corresponding to C220S by EU numbering). In some examples, the exemplary IgG1 Fc set forth in SEQ ID NO:1253 was used, which contained the above mutations and additionally lacked the C-terminal lysine corresponding to position 232 of the wild-type or unmodified Fc set forth in SEQ ID NO: 56 (corresponding to K447del by EU numbering). Other Fc regions also are suitable for generation of stack molecules. Exemplary generated stacks are set forth below.

The homodimeric variant IgV-stacked-Fc fusion molecules containing various configurations of variant IgV domains from PD-L2 (SEQ ID NO: 880) and CD155 (SEQ ID NO:1271) were expressed and purified substantially as described in Example 5. The encoding nucleic acid molecule was designed to produce homodimeric stacks in various configurations of sequences in the order shown:

PD-L2/CD155 Stack 1 (SEQ ID NO: 1121): CD155 variant (SEQ ID NO: 1271)—2×GGGS (SEQ ID NO: 1182)—Fc (SEQ ID NO: 1119)—3×GGGGS (SEQ ID NO: 1181)—PD-L2 (SEQ ID NO: 880)

PD-L2/CD155 Stack 2 (SEQ ID NO: 1122): PD-L2 (SEQ ID NO: 880)—2×GGGS (SEQ ID NO: 1182)—Fc (SEQ ID NO: 1119)—3×GGGGS (SEQ ID NO: 1181)—CD155 variant (SEQ ID NO: 1271)

PD-L2/CD155 Stack 3 (SEQ ID NO: 1123): CD155 variant (SEQ ID NO: 1271)—3×GGGGS (SEQ ID NO: 1181)—PD-L2 (SEQ ID NO: 880)—2×GGGS (SEQ ID NO: 1182)—Fc (SEQ ID NO: 1119)

PD-L2/CD155 Stack 4 (SEQ ID NO: 1124): PD-L2 (SEQ ID NO: 880)—3×GGGGS (SEQ ID NO: 1181)—CD155 variant (SEQ ID NO: 1271)—2×GGGS (SEQ ID NO: 1182)—Fc (SEQ ID NO: 1119)

PD-L2/CD155 Stack 5 (SEQ ID NO: 1125): Fc (SEQ ID NO: 1119)—3×GGGGS (SEQ ID NO: 1181)—CD155 variant (SEQ ID NO: 1271)—3×GGGS (SEQ ID NO: 1181)—PD-L2 (SEQ ID NO: 880)

PD-L2/CD155 Stack 6 (SEQ ID NO: 1126): Fc (SEQ ID NO: 1119)—3×GGGGS (SEQ ID NO: 1181)—PD-L2 (SEQ ID NO: 880)—3×GGGS (SEQ ID NO: 1181)—CD155 variant (SEQ ID NO: 1271)

Heterodimeric stacks were generated in two ways. The first way was by co-expression of the variant PD-L2 IgV and/or variant CD155 IgV fused to (1) a first "knob" Fc subunit (set forth in SEQ ID NO:1117 containing the mutations S354C and T366W by EU numbering, corresponding to S139C and T151W with reference to wild-type human IgG1 Fc set forth in SEQ ID NO:56); and (2) a second "hole" Fc subunit (set forth in SEQ ID NO:1118 containing the mutations Y349C, T366S, L368A and Y407V by EU numbering, corresponding to Y134C, T151S, L153A and Y192V with reference to wild-type human IgG1 Fc set forth in SEQ ID NO:56) for expression of a heterodimeric molecule by "knobs-into-hole" engineering. In addition, both the knob and hole Fe also contained mutations L19A, L20E, G22A to reduce effector function and contained replacement of the cysteine residue to a serine residue at position 5 (C5S), each compared to the wild-type or unmodified Fc set forth in SEQ ID NO: 56 (corresponding to C220S, L234A, L235E and G237A by EU numbering, respectively). In a second way, PDL2 and/or CD155 were fused to both knob and hole Fc's to generate stacks where each chain contains Fc with fused IgV domain(s). For constructs in which the Fc sequence was the N-terminal portion of the sequence, a stuffer sequence HMSSVSAQ (SEQ ID NO:1120) was added immediately preceding the Fc sequence.

The heterodimeric variant IgV-stacked-Fc fusion molecules containing various configurations of variant IgV domains from PD-L2 (SEQ ID NO: 880) and CD155 (SEQ ID NO:1271) were expressed and purified substantially as described in Example 5. For each stack, the encoding nucleic acid molecule of the knob and hole were designed to produce heterodimeric stacks in various configurations with sequences in the order shown:

PD-L2/CD155 Stack 7 containing (1) knob Fc fusion (SEQ ID NO:1127): CD155 variant (SEQ ID NO: 1271)—2×GGGS (SEQ ID NO: 1182)—knob Fc (SEQ ID NO: 1117)—3×GGGGS (SEQ ID NO: 1181)—PD-L2 (SEQ ID NO: 880) and (2) hole Fc (SEQ ID NO: 1118 plus N-terminal HMSSVSAQ set forth in SEQ ID NO:1120)

PD-L2/CD155 Stack 8 containing (1) knob Fc fusion (SEQ ID NO:1128): PD-L2 (SEQ ID NO: 880)—2× GGGS (SEQ ID NO: 1182)—knob Fc (SEQ ID NO: 1117)—3×GGGGS (SEQ ID NO: 1181)—CD155 variant (SEQ ID NO: 1271) and (2) hole Fc (SEQ ID NO:1118 plus N-terminal HMSSVSAQ set forth in SEQ ID NO:1120)

PD-L2/CD155 Stack 9 containing (1) knob Fc fusion (SEQ ID NO:1129): CD155 variant (SEQ ID NO: 1271)—3×GGGGS (SEQ ID NO: 1181)—CD155 variant (SEQ ID NO: 1271)—2×GGGS (SEQ ID NO:

1182)—knob Fc (SEQ ID NO: 1117)—3×GGGGS (SEQ ID NO: 1181)—PD-L2 (SEQ ID NO: 880)—3× GGGGS (SEQ ID NO: 1181)—PD-L2 (SEQ ID NO: 880); and (2) hole Fc (SEQ ID NO:1118 plus N-terminal HMSSVSAQ set forth in SEQ ID NO:1120)

PD-L2/CD155 Stack 10 containing (1) knob Fc fusion (SEQ ID NO:1130): PD-L2 (SEQ ID NO: 880)—3× GGGGS (SEQ ID NO: 1181)—PD-L2 (SEQ ID NO:880)—2×GGGS (SEQ ID NO: 1182)—knob Fc (SEQ ID NO: 1117)—3×GGGGS (SEQ ID NO: 1181)—CD155 variant (SEQ ID NO: 1271)—3× GGGGS (SEQ ID NO: 1181)—CD155 variant (SEQ ID NO: 1271); and (2) hole Fc (SEQ ID NO: 1118 plus N-terminal HMSSVSAQ set forth in SEQ ID NO:1120)

PD-L2/CD155 Stack 11 containing (1) knob fc fusion (SEQ ID NO: 1131): CD155 variant (SEQ ID NO: 1271)—3×GGGGS (SEQ ID NO: 1181)—CD155 variant (SEQ ID NO: 1271)—2×GGGS (SEQ ID NO: 1182)—knob Fc (SEQ ID NO: 1117); and (2) hole Fc fusion (SEQ ID NO:1132):PD-L2 (SEQ ID NO: 880)—3×GGGGS (SEQ ID NO: 1181)—PD-L2 (SEQ ID NO: 880)—2×GGGS (SEQ ID NO: 1182)—hole Fc (SEQ ID NO: 1118)

PD-L2/CD155 Stack 12 containing (1) knob fc fusion (SEQ ID NO: 1133): knob Fc (SEQ ID NO: 1117 plus N-terminal HMSSVSAQ set forth in SEQ ID NO:1120)—3×GGGGS (SEQ ID NO: 1181)—CD155 variant (SEQ ID NO: 1271)—3×GGGGS (SEQ ID NO: 1181) CD155 variant (SEQ ID NO: 1271); and (2) hole Fc (SEQ ID NO:1134): hole Fc (SEQ ID NO: 1118 plus N-terminal HMSSVSAQ set forth in SEQ ID NO: 1120)—3×GGGGS (SEQ ID NO: 1181)—PD-L2 (SEQ ID NO: 880)—3×GGGGS (SEQ ID NO: 1181)—PD-L2 (SEQ ID NO: 880)

PD-L2/CD155 Stack 13 containing (1) knob Fc fusion (SEQ ID NO:1129): CD155 variant (SEQ ID NO: 1271)—3×GGGGS (SEQ ID NO: 1181)—CD155 variant (SEQ ID NO: 1271)—2×GGGS (SEQ ID NO: 1182)—knob Fc (SEQ ID NO: 1117)—3×GGGGS (SEQ ID NO: 1181)—PD-L2 (SEQ ID NO: 880)—3× GGGGS (SEQ ID NO: 1181)—PD-L2 (SEQ ID NO: 880); and (2) hole Fc (SEQ ID NO:1134): hole Fc (SEQ ID NO: 1118 plus N-terminal HMSSVSAQ set forth in SEQ ID NO:1120)—3×GGGGS (SEQ ID NO: 1181)—PD-L2 (SEQ ID NO: 880)—3×GGGGS (SEQ ID NO: 1181)—PD-L2 (SEQ ID NO: 880)

PD-L2/CD155 Stack 14 containing (1) knob Fc fusion (SEQ ID NO:1129): CD155 variant (SEQ ID NO: 1271)—3×GGGGS (SEQ ID NO: 1181)—CD155 variant (SEQ ID NO: 1271)—2×GGGS (SEQ ID NO: 1182)—knob Fc (SEQ ID NO: 1117)—3×GGGGS (SEQ ID NO: 1181)—PD-L2 (SEQ ID NO: 880)—3× GGGGS (SEQ ID NO: 1181)—PD-L2 (SEQ ID NO: 880); and (2) hole Fc fusion (SEQ ID NO:1132): PD-L2 (SEQ ID NO: 880)—3×GGGGS (SEQ ID NO: 1181)—PD-L2 (SEQ ID NO: 880)—2×GGGS (SEQ ID NO: 1182)—hole Fc (SEQ ID NO: 1118)

PD-L2/CD155 Stack 15 containing (1) knob Fc fusion (SEQ ID NO:1130): PD-L2 (SEQ ID NO: 880)—3× GGGGS (SEQ ID NO: 1181)—PD-L2 (SEQ ID NO:880)—2×GGGS (SEQ ID NO: 1182)—knob Fc (SEQ ID NO: 1117)—3×GGGGS (SEQ ID NO: 1181)—CD155 variant (SEQ ID NO: 1271)—3× GGGGS (SEQ ID NO: 1181)—CD155 variant (SEQ ID NO: 1271); and (2) hole Fc fusion (SEQ ID NO:1132): PD-L2 (SEQ ID NO: 880)—3×GGGGS (SEQ ID NO: 1181)—PD-L2 (SEQ ID NO: 880) 2×GGGS (SEQ ID NO: 1182)—hole Fc (SEQ ID NO: 1118)

PD-L2/CD155 Stack 16 containing (1) knob Fc fusion (SEQ ID NO:1130): PD-L2 (SEQ ID NO: 880)—3× GGGGS (SEQ ID NO: 1181)—PD-L2 (SEQ ID NO:880)—2×GGGS (SEQ ID NO: 1182)—knob Fc (SEQ ID NO: 1117)—3×GGGGS (SEQ ID NO: 1181)—CD155 variant (SEQ ID NO: 1271)—3× GGGGS (SEQ ID NO: 1181)—CD155 variant (SEQ ID NO: 1271); and (2) hole Fc (SEQ ID NO: 1134): hole Fe (SEQ ID NO: 1118 plus N-terminal HMSSVSAQ set forth in SEQ ID NO:1120)—3× GGGGS (SEQ ID NO: 1181)—PD-L2 (SEQ ID NO: 880)—3×GGGGS (SEQ ID NO: 1181)—PD-L2 (SEQ ID NO: 880)

Example 12

Assessment of Binding to Cell-Expressed Counter Structures and Bioactivity of Affinity-Matured IgSF Domain-Containing Stack Molecules This Example describes Fc-fusion binding studies to show specificity and affinity of exemplary PD-L2/CD155 stack immunomodulatory proteins generated in Example 11 for cognate binding partners. The exemplary PD-L2/CD155 stack immunomodulatory proteins generated in Example 11 also were assessed for Fc-fusion variant protein bioactivity characterization in a human primary T cell in vitro assay.

A. Binding to Cell-Expressed Counter Structure

Binding studies were carried out using Jurkat/IL-2 reporter cells (purchased from Promega Corp. USA) that were transduced to stably express human PD-1 (Jurkat/PD-1 cells), human TIGIT (Jurkat/TIGIT cells) or both PD-1 and TIGIT (Jurkat/PD-1/TIGIT cells). For staining by flow cytometry, 100,000 Jurkat/PD-1, Jurkat/TIGIT, Jurkat/PD-1/TIGIT cells or negative control (Jurkat only) were plated in 96-well round-bottom plates. Cells were spun down and resuspended in staining buffer (PBS (phosphate buffered saline), 1% BSA (bovine serum albumin), and 0.1% sodium azide) for 20 minutes to block non-specific binding. Afterwards, cells were centrifuged again and resuspended in 50 μL staining buffer containing 100 nM to 46 pM of each candidate Fc fusion protein. Primary staining was performed on ice for 90 minutes, before washing cells twice in 200 μL staining buffer. PE-conjugated anti-human Fe (Jackson ImmunoResearch, USA) was diluted 1:150 in 50 μL staining buffer and added to cells and incubated another 30 minutes on ice. Secondary antibody was washed out twice, cells were fixed in 400 formalin/PBS, and samples were analyzed on Intellicyt flow cytometer (Intellicyt Corp., USA).

Mean Fluorescence Intensity (MFI) was calculated with FlowJo Version 10 software (FlowJo LLC, USA). Table 17 sets forth binding activity as measured by the Mean Fluorescence Intensity (MFI) value for binding of 6.25 nM of each stack Fc-fusion molecule to Jurkat/PD-1, Jurkat/TIGIT, and Jurkat/PD-1/TIGIT cells. As shown in Table 17, several stack proteins bind both PD-1 and TIGIT with high affinity.

TABLE 17

| | | | Binding to Jurkat Transfectants MFI at 6.25 nM | | |
|---|---|---|---|---|---|
| Category | Description | SEQ ID NO | PD1 | TIGIT | TIGIT + PD1 |
| Homodimers | (CD155 IgV)-(G4S)2-Fc-(G4S)3-(PD-L2 IgV) | 1121 | 242 | 19948 | 5336 |
| | (PD-L2 IgV)-(G4S)2-Fc-(G4S)3-(CD155 IgV) | 1122 | 16344 | 9095 | 16458 |
| | (CD155 IgV)-(G4S)3-(PD-L2 IgV)-(G4S)2-Fc | 1123 | 91 | 22342 | 8135 |
| | (PD-L2 IgV)-(G4S)3-(CD155 IgV)-(G4S)2-Fc | 1124 | 9218 | 14516 | 19256 |
| | Fc-(G4S)3-(CD155 IgV)-(G4S)3-(PD-L2 IgV) | 1125 | 108 | 5486 | 2905 |
| | Fc-(G4S)3-(PD-L2 IgV)-(G4S)3-(CD155 IgV) | 1126 | 66 | 9974 | 5202 |
| Heterodimers | (CD155 IgV)-(G4S)2-knob Fc-(G4S)3-(PD-L2 IgV) and hole Fc | 1127 + 1118 | 107 | 2544 | 1512 |
| | (PD-L2 IgV)-(G4S)2-knob Fc-(G4S)3-(CD155 IgV) and hole Fc | 1128 + 1118 | 1658 | 360 | 6762 |
| | (CD155 IgV)-(G4S)3-(CD155 IgV)-(G4S)2-knob Fc-(G4S)3-(PD-L2 IgV)-(G4S)3-(PD-L2 IgV) and hole Fc | 1129 + 1118 | 289 | 8677 | 4371 |
| | (PD-L2 IgV)-(G4S)3-(PD-L2 IgV)-(G4S)2-knob Fc-(G4S)3-(CD155 IgV)-(G4S)3-(CD155 IgV) and hole Fc | 1130 + 1118 | 1594 | 2554 | 5509 |
| | (CD155 IgV)-(G4S)3-(CD155 IgV)-(G4S)2-knob Fc and (PD-L2 IgV)-(G4S)3-(PD-L2 IgV)-(G4S)2-hole Fc | 1131 + 1132 | 1758 | 9642 | 9343 |
| | (CD155 IgV)-(G4S)3-(CD155 IgV)-(G4S)2-knob Fc-(G4S)3-(PD-L2 IgV)-(G4S)3-(PD-L2 IgV) and (PD-L2 IgV)-(G4S)3-(PD-L2 IgV)-(G4S)2-hole Fc | 1129 + 1132 | 4821 | 7596 | 8081 |

TABLE 17-continued

Binding of PD-L2/CD155 Stacks to Cell-Expressed Counter Structure

| | | | Binding to Jurkat Transfectants MFI at 6.25 nM | | |
| Category | Description | SEQ ID NO | PD1 | TIGIT | TIGIT + PD1 |
|---|---|---|---|---|---|
| | (CD155 IgV)-(G4S)3-(CD155 IgV)-(G4S)2-knob Fc-(G4S)3-(PD-L2 IgV)-(G4S)3-(PD-L2 IgV) and hole Fc-(G4S)3-(PD-L2 IgV)-(G4S)3-(PD-L2 IgV) | 1129 + 1134 | 515 | 8299 | 4228 |
| | (PD-L2 IgV)-(G4S)3-(PD-L2 IgV)-(G4S)2-knob Fc-(G4S)3-(CD155 IgV)-(G4S)3-(CD155 IgV) and (PD-L2 IgV)-(G4S)3-(PD-L2 IgV)-(G4S)2-hole Fc | 1130 + 1132 | 10970 | 3339 | 9014 |
| | (PD-L2 IgV)-(G4S)3-(PD-L2 IgV)-(G4S)2-knob Fc-(G4S)3-(CD155 IgV)-(G4S)3-(CD155 IgV) and hole Fc-(G4S)3-(PD-L2 IgV)-(G4S)3-(PD-L2 IgV) | 1130 + 1134 | 3785 | 1475 | 5989 |
| Controls | PDL2-IgV | 880 | 22448 | 73 | 20280 |
| | CD155-IgV | 1271 | 133 | 22342 | 4893 |
| | Fc Control (homodimer) | 1119 | 44 | 86 | 66 |
| | Fc Control (heterodimer) | 1117 + 1118 | 42 | 48 | 48 |
| | Wild Type CD155 full ECD Fc | 20 (ECD) | 64 | 4547 | 249 |
| | Wild Type PD-L2 full ECD Fc | 4 (ECD) | 392 | 46 | 314 |
| | Irrelevant Ig Control | hIgG | 41 | 48 | 41 |

B. Assessment of Bioactivity of Affinity-Matured IgSF Domain-Containing Molecules Using Mixed Lymphocyte Reaction (MLR)

Soluble PD-L2/CD155 stack protein bioactivity was tested in a human Mixed Lymphocyte Reaction (MVLR). Human primary dendritic cells (DC) were generated by culturing monocytes isolated from PBMC (BenTech Bio, USA) in vitro for 7 days with 50 ng/mL rIL-4 (R&D Systems, USA) and 80 ng/mL rGM-CSF (R&D Systems, USA) in Ex-Vivo 15 media (Lonza, Switzerland). To induce DC maturation, lipopolysaccharide (LPS) (InvivoGen Corp., USA) was added to the DC cultures on day 6 and cells were incubated for an additional 24 hours. Approximately 10,000 matured DC and 100,000 purified allogeneic CD3+ T cells (BenTech Bio, USA) were co-cultured with several concentrations of PD-L2/CD155 stack or control proteins in 96 well round-bottom plates in 200 µL final volume of Ex-Vivo 15 media. Irrelevant human IgG and homodimeric and heterodimeric empty Fc proteins were used as negative controls. As positive controls, PD-L2-Fc (full PD-L2 extracellular domain), wildtype CD155-Fc (full CD155 extracellular domain) were assessed. Variant PD-L2 IgV-Fc fusion proteins were tested at 20 nM. On day 5, IFN-gamma secretion in culture supernatants was analyzed using the Human IFN-gamma Duoset ELISA kit (R&D Systems, USA). Optical density was measured on a BioTek Cytation Multimode Microplate Reader (BioTek Corp., USA) and quantitated against titrated rIFN-gamma standard included in the IFN-gamma Duo-set kit (R&D Systems, USA).

Results for the bioactivity studies for exemplary tested PD-L2/CD155 stack proteins are summarized in Table 18, which sets forth the calculated levels of IFN-gamma in culture supernatants (pg/ml). The sequence identifier (SEQ ID NO) for each stack proteins is set forth in column 3. As shown in Table 18, culture supernatants incubated in the presence of exemplary PD-L2/CD155 stack proteins exhibited altered levels of IFNg production in the MLR assay.

TABLE 18

Bioactivity Data of PD-L2/CD155 Stacks

| | | | Mixed Lymphocyte Reaction: IFNg at 96 hours | |
| Category | Description | SEQ ID NO | IFNg [pg/mL] | Fold Increase compared to IgG Control |
|---|---|---|---|---|
| Homodimers | (CD155 IgV)-(G4S)2-Fc-(G4S)3-(PD-L2 IgV) | 1121 | 3097.0 | 1.3 |
| | (PD-L2 IgV)-(G4S)2-Fc-(G4S)3-(CD155 IgV) | 1122 | 3700.3 | 1.6 |
| | (CD155 IgV)-(G4S)3-(PD-L2 IgV)-(G4S)2-Fc | 1123 | 3061.6 | 1.3 |

TABLE 18-continued

Bioactivity Data of PD-L2/CD155 Stacks

| Category | Description | SEQ ID NO | Mixed Lymphocyte Reaction: IFNg at 96 hours | |
| --- | --- | --- | --- | --- |
| | | | IFNg [pg/mL] | Fold Increase compared to IgG Control |
| | (PD-L2 IgV)-(G4S)3-(CD155 IgV)-(G4S)2-Fc | 1124 | 2270.0 | 1.0 |
| | Fc-(G4S)3-(CD155 IgV)-(G4S)3-(PD-L2 IgV) | 1125 | 2003.5 | 0.9 |
| | Fc-(G4S)3-(PD-L2 IgV)-(G4S)3-(CD155 IgV) | 1126 | 2951.0 | 1.3 |
| Heterodimers | (CD155 IgV)-(G4S)2-knob Fc-(G4S)3-(PD-L2 IgV) and hole Fc | 1127 + 1118 | 2040.4 | 0.9 |
| | (PD-L2 IgV)-(G4S)2-knob Fc-(G4S)3-(CD155 IgV) and hole Fc | 1128 + 1118 | 3768.6 | 1.6 |
| | (CD155 IgV)-(G4S)3-(CD155 IgV)-(G4S)2-knob Fc-(G4S)3-(PD-L2 IgV)-(G4S)3-(PD-L2 IgV) and hole Fc | 1129 + 1118 | 3549.7 | 1.5 |
| | (PD-L2 IgV)-(G4S)3-(PD-L2 IgV)-(G4S)2-knob Fc-(G4S)3-(CD155 IgV)-(G4S)3-(CD155 IgV) and hole Fc | 1130 + 1118 | 2568.6 | 1.1 |
| | (CD155 IgV)-(G4S)3-(CD155 IgV)-(G4S)2-knob Fc and (PD-L2 IgV)-(G4S)3-(PD-L2 IgV)-(G4S)2-hole Fc | 1131 + 1132 | 2572.1 | 1.1 |
| | (CD155 IgV)-(G4S)3-(CD155 IgV)-(G4S)2-knob Fc-(G4S)3-(PD-L2 IgV)-(G4S)3-(PD-L2 IgV) and (PD-L2 IgV)-(G4S)3-(PD-L2 IgV)-(G4S)2-hole Fc | 1129 + 1132 | 3216.7 | 1.4 |
| | (CD155 IgV)-(G4S)3-(CD155 IgV)-(G4S)2-knob Fc-(G4S)3-(PD-L2 IgV)-(G4S)3-(PD-L2 IgV) and hole Fc-(G4S)3-(PD-L2 IgV)-(G4S)3-(PD-L2 IgV) | 1129 + 1134 | 2673.4 | 1.2 |
| | (PD-L2 IgV)-(G4S)3-(PD-L2 IgV)-(G4S)2-knob Fc-(G4S)3-(CD155 IgV)-(G4S)3-(CD155 IgV) and (PD-L2 IgV)-(G4S)3-(PD-L2 IgV)-(G4S)2-hole Fc | 1130 + 1132 | 2361.6 | 1.0 |
| | (PD-L2 IgV)-(G4S)3-(PD-L2 IgV)-(G4S)2-knob Fc-(G4S)3-(CD155 IgV)-(G4S)3-(CD155 IgV) and hole Fc-(G4S)3-(PD-L2 IgV)-(G4S)3-(PD-L2 IgV) | 1130 + 1134 | 3311.8 | 1.4 |
| Controls | PDL2-IgV | 880 | 2367.2 | 1.0 |
| | CD155-IgV | 1271 | 2590.7 | 1.1 |
| | Fc Control (homodimer) | 1119 | 2617.9 | 1.1 |
| | Fc Control (heterodimer) | 1117 + 1118 | 2861.5 | 1.2 |
| | Wild Type CD155 full ECD Fc | 20 (ECD) | 2481.0 | 1.1 |
| | Wild Type PD-L2 full ECD Fc | 4 (ECD) | 3298.5 | 1.4 |
| | Irrelevant Ig Control | hIgG | 2297.6 | 1.0 |

Example 13

Generation of Multi-Domain Stacked Molecules Containing Different Affinity-Modified Domains This Example describes immunomodulatory proteins that were generated as multi-domain stack constructs containing at least two different affinity modified IgV domains from identified variant PD-L1 polypeptides, identified variant CD112 polypeptides and identified variant CD155 polypeptides described above. Specifically, the exemplary variant PD-L1 IgV D43G/N45D/L56Q/V58A/G101G-ins (G101GG) (SEQ ID NO: 659), CD112 IgV molecule S118F (SEQ ID NO: 1374) and/or the exemplary variant CD155 IgV molecule P18S/S65W/S67A/L104Q/G111R (SEQ ID NO: 1271) were linked together and fused to an Fc in various configurations.

Homodimeric stacks were generated in various configurations as summarized in FIGS. 5A and 5B and as follows. In the generated homodimeric stack constructs, the variant CD155 IgV variant, CD112 IgV and/or variant PD-L1 IgV were variously linked to the N- or C-terminus of a human IgG1 Fc region via a 2×GGGS (SEQ ID NO:1182) or 3×GGGGS (SEQ ID NO: 1181) peptide linker. In this study, the exemplary IgG1 Fc region is set forth in SEQ ID NO:1119 and contained the mutations L234A, L235E, G237A, E356D and M358L by EU numbering (corresponding to L19A, L20E, G22A, E141D and M143L with reference to wild-type human IgG1 Fc set forth in SEQ ID NO:56). Further, the Fc region contained replacement of the cysteine residues to a serine residue at position 5 (C5S) compared to the wild-type or unmodified Fc set forth in SEQ ID NO: 56 (corresponding to C220S by EU numbering). In some examples, the Fc was further modified to remove the C-terminal lysine at position 232 of the wild-type or unmodified Fc set forth in SEQ ID NO: 56 (corresponding to K447del by EU numbering). The exemplary IgG1 Fc region comprising a lysine deletion is set forth in SEQ ID NO: 1253. Other Fc regions also are suitable for generation of stack molecules. Exemplary generated stacks are set forth below.

Expression constructs encoding Fc fusion proteins of interest were transiently expressed in Expi293 HEK293 cells from Invitrogen using the manufacturer's commercial Expifectamine reagents and media. Supernatants were harvested and protein was captured and eluted from a Protein A column using an AKTA protein purification system. The eluted material was then separated by an additional preparative SEC step to generate monomeric, highly purified material. The purified proteins were formulated in 15 mM acetate, 200 mM NaCl, 9% sucrose, pH 5.0 (ASUS). The protein was vialed in a sterile biosafety cabinet and frozen at −80 C. A vial was thawed and assessed by analytical SEC to demonstrate the material was stable and predominantly monomeric after thaw.

For each stack, the encoding nucleic acid molecule was designed to produce homodimeric stacks in various configurations with sequences in the order shown:

A. Stack Constructs Containing PD-L1 and CD155

PD-L1/CD155 Stack 1 (SEQ ID NO: 1254): CD155 variant (SEQ ID NO: 1271)—2×GGGS (SEQ ID NO: 1182)—Fc (SEQ ID NO: 1119)—3×GGGGS (SEQ ID NO: 1181)—PD-L1 (SEQ ID NO: 659)

PD-L1/CD155 Stack 2 (SEQ ID NO: 1255): PD-L1 (SEQ ID NO: 659)—2×GGGS (SEQ ID NO: 1182)—Fc (SEQ ID NO: 1119)—3×GGGGS (SEQ ID NO: 1181)—CD155 variant (SEQ ID NO: 1271)

PD-L1/CD155 Stack 3 (SEQ ID NO: 1256): CD155 variant (SEQ ID NO: 1271)—3×GGGGS (SEQ ID NO: 1181)—PD-L1 (SEQ ID NO: 659)—2×GGGS (SEQ ID NO: 1182)—Fc (SEQ ID NO: 1119)

PD-L1/CD155 Stack 4 (SEQ ID NO: 1257): PD-L1 (SEQ ID NO: 659)—3×GGGGS (SEQ ID NO: 1181)—CD155 variant (SEQ ID NO: 1271)—2×GGGS (SEQ ID NO: 1182)—Fc (SEQ ID NO: 1119)

PD-L1/CD155 Stack 5 (SEQ ID NO: 1258): N-terminal HMSSVSAQ set forth in SEQ ID NO:1120—Fc (SEQ ID NO: 1119)—3×GGGGS (SEQ ID NO: 1181)—CD155 variant (SEQ ID NO: 1271)—3×GGGS (SEQ ID NO: 1181)—PD-L1 (SEQ ID NO: 659)

PD-L1/CD155 Stack 6 (SEQ ID NO: 1259): N-terminal HMSSVSAQ set forth in SEQ ID NO:1120—Fc (SEQ ID NO: 1119)—3×GGGGS (SEQ ID NO: 1181)—PD-L1 (SEQ ID NO: 659)—3×GGGS (SEQ ID NO: 1181)—CD155 variant (SEQ ID NO: 1271)

B. Stack Constructs Containing CD112 and CD155

CD112/CD155 Stack 1 (SEQ ID NO: 1260): CD155 variant (SEQ ID NO: 1271)—2×GGGS (SEQ ID NO: 1182)—Fc with lysine removed (SEQ ID NO: 1253)—3×GGGGS (SEQ ID NO: 1181)—CD112 (SEQ ID NO: 1374)

CD112/CD155 Stack 2 (SEQ ID NO: 1261): CD112 (SEQ ID NO: 1374)—2×GGGS (SEQ ID NO: 1182)—Fc with lysine removed (SEQ ID NO: 1253)—3×GGGGS (SEQ ID NO: 1181)—CD155 variant (SEQ ID NO: 1271)

CD112/CD155 Stack 3 (SEQ ID NO: 1262): CD155 variant (SEQ ID NO: 1271)—3×GGGGS (SEQ ID NO: 1181)—CD112 (SEQ ID NO: 1374)—2×GGGS (SEQ ID NO: 1182)—Fc (SEQ ID NO: 1119)

CD112/CD155 Stack 4 (SEQ ID NO: 1263): CD112 (SEQ ID NO: 1374)—3×GGGGS (SEQ ID NO: 1181)—CD155 variant (SEQ ID NO: 1271)—2× GGGS (SEQ ID NO:1182)—Fc (SEQ ID NO:1119)

CD112/CD155 Stack 5 (SEQ ID NO: 1264): N-terminal HMSSVSAQ set forth in SEQ ID NO:1120—Fc with lysine removed (SEQ ID NO: 1253)—3×GGGGS (SEQ ID NO: 1181)—CD112 (SEQ ID NO: 1374)—3×GGGS (SEQ ID NO: 1181)—CD155 variant (SEQ ID NO: 1271)

CD112/CD155 Stack 6 (SEQ ID NO: 1265): N-terminal HMSSVSAQ set forth in SEQ ID NO: 1120—Fc with lysine removed (SEQ ID NO: 1253)—3×GGGGS (SEQ ID NO: 1181)—CD155 variant (SEQ ID NO: 1271)—3×GGGGS (SEQ ID NO: 1181)

CD112 (SEQ ID NO: 1374)

C. Stack Constructs Containing PD-L1, CD112 and CD155

PD-L1/CD112/CD155 Stack 1 (SEQ ID NO: 1266): PD-L1 (SEQ ID NO: 659)—3×GGGS (SEQ ID NO: 1181)—CD155 variant (SEQ ID NO: 1271)—2× GGGS (SEQ ID NO: 1182)—Fc with lysine removed (SEQ ID NO: 1253)—3×GGGGS (SEQ ID NO: 1181)—CD112 (SEQ ID NO: 1374)

PD-L1/CD112/CD155 Stack 2 (SEQ ID NO: 1267): PD-L1 (SEQ ID NO: 659)—3×GGGS (SEQ ID NO: 1181)—CD155 variant (SEQ ID NO: 1271)—3× GGGS (SEQ ID NO: 1181)—CD112 (SEQ ID NO: 1374)—2×GGGS (SEQ ID NO: 1182)—Fc (SEQ ID NO: 1119)

PD-L1/CD112/CD155 Stack 3 (SEQ ID NO: 1268): PD-L1 (SEQ ID NO: 659)—3×GGGS (SEQ ID NO: 1181)—CD112 (SEQ ID NO: 1374)—3×GGGS (SEQ ID NO: 1181)—CD155 variant (SEQ ID NO: 1271)—2×GGGS (SEQ ID NO: 1182)—Fc (SEQ ID NO: 1119)

Example 14

Assessment of Binding and Bioactivity of PD-L1/CD155 Stacked Affinity-Matured IgSF Domain-Containing Molecules This Example describes binding studies to assess specificity and affinity of exemplary PD-L1/CD155 variant IgV stack immunomodulatory proteins (PD-L1/CD155 stacked IgV-Fc), generated in Example 13, for binding to cognate binding partners. In addition, a Jurkat/IL2/PD1/TIGIT reporter assay was used to assess PD-1 and TIGIT blocking activity of PD-L1/CD155 stacked IgV-Fc molecules. As a control, binding and blocking activity also was assessed of the non-stack variant PD-L1 IgV-Fc or CD155 IgV-Fc fusion molecules containing the same variant PD-L1 IgV (SEQ ID NO:659) or variant CD155 IgV (SEQ ID NO:1271), respectively, used in the stacks. Wild-type CD155-ECD-Fc and wild-type PD-L1-ECD-Fc containing the wildtype CD155 ECD (SEQ ID NO:20) or the wildtype PD-L1 ECD (SEQ ID NO:3), respectively, also were assessed.

A. Binding to Cell-Expressed Counter Structure

Binding studies were carried out using Jurkat/IL-2 reporter cells (purchased from Promega Corp. USA) that were transduced to stably express human PD-1 (Jurkat/PD-1 cells), human TIGIT (Jurkat/TIGIT cells) or both PD-1 and TIGIT (Jurkat/PD-1/TIGIT cells). For staining by flow cytometry, 100,000 Jurkat/PD-1, Jurkat/TIGIT, Jurkat/PD-1/TIGIT cells or negative control (Jurkat only) were plated in 96-well round-bottom plates. Cells were spun down and resuspended in staining buffer (PBS (phosphate buffered saline), 1% BSA (bovine serum albumin), and 0.1% sodium azide) for 20 minutes to block non-specific binding. Afterwards, cells were centrifuged again and resuspended in 50 µL staining buffer containing 100 nM to 6 pM of each candidate Fc fusion protein, either variant PD-L1 IgV-Fc or CD155 IgV-Fc fusion molecules or PD-L1/CD155 stacked IgV-Fc fusion molecules described above. Primary staining was performed on ice for 90 minutes, before washing cells twice in 200 µL staining buffer. PE-conjugated anti-human Fc (Jackson ImmunoResearch, USA) was diluted 1:150 in 50 µL staining buffer and added to cells and incubated another 30 minutes on ice. Secondary antibody was washed out twice, cells were fixed in 4% formaldehyde/PBS, and samples were analyzed on Intellicyt flow cytometer (Intellicyt Corp., USA).

Mean Fluorescence Intensity (MFI) was calculated with FlowJo Version 10 software (FlowJo LLC, USA). Table 19 sets forth the binding activity as measured by the Mean Fluorescence Intensity (MFI) value for binding of 20 nM of each stack Fc-fusion molecule, non-stack variant PD-L1 IgV-Fc or CD155 IgV-Fc controls or wild-type ECD controls, to Jurkat/PD-1, Jurkat/TIGIT, and Jurkat/PD-1/TIGIT cells. As shown in Table 19, several stack proteins bound both PD-1 and TIGIT with high affinity.

nM, 100 nM, 25 nM, 6.25 nM, and 1.56 nM. The Jurkat cells with test or control proteins were incubated for 15 minutes at room temperature. CHO-derived artificial antigen presenting cells (aAPC) displaying transduced cell surface anti-CD3 single chain Fv (OKT3), PD-L1 and CD155 were brought to $0.8 \times 10^6$ cells/mL and 25 µL of cells was added to each well bringing the final volume of each well to 100 µL. Each well had a final ratio of 5:1 Jurkat:CHO cells and a test protein concentration of 100, 25, 6.25, 1.56 or 0.47 nM and an anti-CD28 concentration of 1.5 µg/mL. Jurkat cells and CHO cells were incubated for 5 hours at 37 degrees Celsius in a humidified 5% $CO_2$ incubation chamber. Plates are then removed from the incubator and acclimated to room temperature for 15 minutes. 100 µL of a cell lysis and luciferase substrate solution (BioGlo luciferase reagent, Promega) was added to each well and the plates were incubated on an orbital shaker for 10 minutes. Luminescence was measured with a 1 second per well integration time using a BioTek Cytation luminometer.

An average relative luminescence value was determined for each test sample and a fold increase (or decrease) in IL-2 reporter signal was calculated for each stack molecule compared to non-stack variant PD-L1 IgV-Fc and variant

TABLE 19

| | | Flow Binding to Jurkat Cells Stably Expressing: | | |
| --- | --- | --- | --- | --- |
| SEQ ID NO | Description | PD-1 | TIGIT | PD-1 + TIGIT |
| 1254 | (CD155 IgV) (G4S)2 Fc (G4S)3 (PD-L1 IgV) | 61805 | 80658 | 35128 |
| 1255 | (PD-L1 IgV) (G4S)2 Fc(G4S)3 (CD155 IgV) | 69813 | 36485 | 52538 |
| 1256 | (CD155 IgV) (G4S)3 (PD-L1 IgV) (G4S)2 Fc | 47261 | 81840 | 32188 |
| 1257 | (PD-L1 IgV) (G4S)3 (CD155 IgV) (G4S)2 Fc | 77959 | 60515 | 51615 |
| 659 | non-stack variant PD-L1 IgV-Fc control | 111746 | 630 | 41390 |
| 1271 | non-stack variant CD155 IgV-Fc control | 460 | 79152 | 7910 |
| 20 (ECD) | CD155-ECD-Fc | 511 | 28790 | 1196 |
| 3 (ECD) | PD-L1-ECD-Fc (R&D Systems) | 35005 | 557 | 10358 |
| 1119 | Fc Control (homodimer) | 437 | 483 | 478 |
| | | MFI at 20 nM | MFI at 20 nM | MFI at 20 nM |

B. Assessment of Bioactivity of Affinity-Matured IgSF Domain-Containing Molecules Jurkat effector cells expressing an IL-2-luciferase reporter and cell-surface PD-1 and TIGIT were suspended at $2 \times 10^6$ cells/mL in Jurkat Assay buffer (RPMI1640+5% FBS) and anti-CD28 was added to a final concentration of 3 µg/mL. Jurkat cells were then plated at 50 µL/well for a total of 100,000 cells per well.

To each well, 25 µL of PD-L1/CD155 stacked IgV-Fc test protein was added to the Jurkat cells. As a control, non-stack variant PD-L1 IgV-Fc or CD155 IgV-Fc fusion molecules, alone or in combination, also were assessed for comparison. Anti-TIGIT antibody (clone MBSA43), anti-PD-1 antibody (nivolumab) or an empty Fc molecule were also used as controls. All proteins were added at five concentrations: 400

CD155 IgV-Fc proteins. Because the assay is a measure of blockade of inhibitory signals, an increase in luminescent signal compared to control indicates the presence of blocking activity.

As shown in Table 20, the luciferase activity of the Jurkat effector cells co-cultured with anti-CD3/PD-L1/CD155 aAPC and 100 nM PD-L1/CD155 stack Fc molecules was altered (increased) for each molecule tested compared to control. The differences in luminescence signals demonstrate the differences in binding of the PD-L1/CD155 stack-Fc molecules to PD-1 and TIGIT and the resulting co-blockade of inhibitory activity. In the Table, Column 1 sets forth the SEQ ID NO identifier for each PD-L1/CD155 stack-Fc variant tested.

TABLE 20

Jurkat/IL2/PD1/TIGIT + CHO/OKT3/PD-L1/CD155 Reporter Assay Results

| SEQ ID NO | Description | RLU | Fold Increase Compared to non-stack variant PD-L1 IgV-Fc control | Fold Increase Compared to non-stack variant CD155 IgV-Fc control | Fold Increase Compared to variant PD-L1 IgV-Fc and variant CD155 IgV-Fc |
|---|---|---|---|---|---|
| 1254 | (CD155 IgV) (G4S)2 Fc (G4S)3 (PD-L1 IgV) | 573 | 0.6 | 1.7 | 0.8 |
| 1255 | (PD-L1 IgV) (G4S)2 Fc(G4S)3 (CD155 IgV) | 962 | 1.0 | 2.8 | 1.4 |
| 1256 | (CD155 IgV) (G4S)3 (PD-L1 IgV) (G4S)2 Fc | 434 | 0.5 | 1.3 | 0.6 |
| 1257 | (PD-L1 IgV) (G4S)3 (CD155 IgV) (G4S)2 Fc | 1923 | 2.0 | 5.6 | 2.7 |
| 659 | non-stack variant PD-L1 IgV-Fc control | 958 | 1.0 | 2.8 | 1.3 |
| 1271 | non-stack variant CD155 IgV-Fc control | 345 | 0.4 | 1.0 | 0.5 |
| — | Anti-TIGIT antibody (clone MBSA43), anti-PD-1 antibody (nivolumab) | 2192 | 2.3 | 6.4 | 3.1 |
| 659 + 1271 | PD-L1 IgV + CD155 IgV | 710 | 0.7 | 2.1 | 1.0 |
| 1119 | Fc Control (homodimer) | 235 | 0.2 | 0.7 | 0.3 |

Example 15

Assessment of Binding and Bioactivity of CD112/CD155 Stacked Affinity-Matured IgSF Domain-Containing Molecules This Example describes binding studies to assess specificity and affinity of CD112/CD155 variant stack immunomodulatory proteins (CD112/CD155 stacked IgV-Fc), generated in Example 13, for binding to cognate binding partners. In addition, a Jurkat/IL2/CD112R/TIGIT reporter assay was used to assess CD112R and TIGIT blocking activity of CD112/CD155 stacked IgV-Fc molecules. As a comparison, binding and blocking activity also was assessed of the non-stack variant CD112 IgV-Fc or CD155 IgV-Fc fusion molecules containing the same variant CD112 IgV (SEQ ID NO:1374) or variant CD155 IgV (SEQ ID NO:1271), respectively, used in the stacks. Wild-type CD155-ECD-Fc and wild-type CD112-ECD-Fc containing the wildtype CD155 ECD (SEQ ID NO:20) or the wildtype CD112 ECD (SEQ ID NO:21), respectively, also were assessed.

A. Binding to Cell-Expressed Counter Structure

Binding studies were carried out using Jurkat/IL-2 reporter cells which endogenously express CD112R (purchased from Promega Corp. USA) that were transduced to stably express human TIGIT (Jurkat/TIGIT cells). For staining by flow cytometry, 100,000 Jurkat parental (CD112R), or Jurkat/TIGIT cells were plated in 96-well round-bottom plates. Cells were spun down and resuspended in staining buffer (PBS (phosphate buffered saline), 1% BSA (bovine serum albumin), and 0.1% sodium azide) for 20 minutes to block non-specific binding. Afterwards, cells were centrifuged again and resuspended in 50 μL staining buffer containing 100 nM to 6 pM of each candidate Fc fusion protein. Primary staining was performed on ice for 90 minutes, before washing cells twice in 200 μL staining buffer. PE-conjugated anti-human Fc (Jackson ImmunoResearch, USA) was diluted 1:150 in 50 μL staining buffer and added to cells and incubated another 30 minutes on ice. Secondary antibody was washed out twice, cells were fixed in 4% formaldehyde/PBS, and samples were analyzed on an LSRII flow cytometer (Becton Dickinson Corp., USA).

Binding values, expressed as Mean Fluorescence Intensity (MFI), were determined for a 33.3 nM concentration of each stack Fc fusion protein and non-stack variant CD112 IgV-Fc or CD155 IgV-Fc fusion molecules. Data was analyzed using FlowJo Version 10 software (FlowJo LLC, USA). Results for the binding studies for exemplary tested CD112/CD155 stack Fc fusion molecules (tested at 33.3 nM) are shown in Table 21. As shown in Table 21, several stack proteins bound TIGIT and/or CD112R with high affinity

TABLE 21

Binding of Stacks to Cell-Expressed Counter Structure

| Category | Description | SEQ ID NO | Binding to Jurkat Transfectants Expressing: | |
|---|---|---|---|---|
| | | | TIGIT | CD112R |
| Stacks | (CD155 IgV) (G4S)2 Fc1.1 (G4S)3 (CD112 IgV) | 1260 | 6430 | 570 |
| | (CD112 IgV) (G4S)2 Fc1.1 (G4S)3 (CD155 IgV) | 1261 | 2003 | 677 |
| | (CD155 IgV) (G4S)3 (CD112 IgV) (G4S)2 Fc1.1 | 1262 | 5958 | 448 |
| | (CD112 IgV) (G4S)3 (CD155 IgV) (G4S)2 Fc1.1 | 1263 | 1734 | 475 |
| | Fc1.1 (G4S)3 (CD112 IgV) (G4S)3 (CD155 IgV) | 1264 | 765 | 458 |

TABLE 21-continued

Binding of Stacks to Cell-Expressed Counter Structure

| | | | Binding to Jurkat Transfectants Expressing: | |
| | | SEQ ID | | |
| Category | Description | NO | TIGIT | CD112R |
|---|---|---|---|---|
| Controls | non-stack variant CD155 IgV-Fc control | 1271 | 6294 | 55 |
| | non-stack variant CD112 IgV-Fc control | 1374 | 358 | 516 |
| | Fc Control | 1119 | 23.3 | 27 |
| | | | MFI at 33.3 nM | |

B. Assessment of Bioactivity of Affinity-Matured IgSF Domain-Containing Molecules Jurkat effector cells expressing an IL-2-luciferase reporter and cell-surface CD112R and TIGIT were suspended at $2\times10^6$ cells/mL in Jurkat Assay buffer (RPMI1640+5% FBS). Jurkat cells were then plated at 50 µL/well for a total of 100,000 cells per well.

To each well, 25 µL of CD112/CD155 stacked IgV-Fc test protein was added to the Jurkat cells. As a control, non-stack variant CD112 IgV-Fc or CD155 IgV-Fc fusion molecules, alone or in combination, also were assessed for comparison. An empty Fc molecule was used as a negative control. All proteins were added at three concentrations: 400 nM, 100 nM, and 25 nM. The Jurkat cells with test or control proteins were incubated for 15 minutes at room temperature. K562-derived artificial antigen presenting cells (aAPC) displaying endogenous CD155 and CD112 and transduced cell surface anti-CD3 single chain Fv (OKT3) and CD80 were brought to $0.8\times10^6$ cells/mL and 25 µL of cells was added to each well bringing the final volume of each well to 100 µL. Each well had a final ratio of 5:1 Jurkat:K562 and a test protein orbital shaker for 10 minutes. Luminescence was measured with a 1 second per well integration time using a BioTek Cytation luminometer.

An average relative luminescence value was determined for each test sample and a fold increase (or decrease) in IL-2 reporter signal was calculated for each stack molecule compared to non-stack variant CD112 IgV-Fc and variant CD155 IgV-Fc proteins. Because the assay is a measure of blockade of inhibitory signals, an increase in luminescent signal compared to control indicates the presence of blocking activity.

As shown in Table 22, the luciferase activity of the Jurkat effector cells co-cultured with anti-CD3/CD112/CD155 aAPC and CD112/CD155 stack Fc molecules was altered (increased) for each molecule tested compared to control. The differences in luminescence signals demonstrate the differences in binding of the CD112/CD155 stack-Fc molecules to CD112R and TIGIT and the resulting co-blockade of inhibitory activity. In the Table, Column 2 sets forth the SEQ ID NO identifier for each CD112/CD155 stack-Fc variant tested.

TABLE 22

Jurkat/IL2/TIGIT + K562/OKT3/CD80 Reporter Assay Results

| Description | SEQ ID NO | RLU | Fold Increase Compared to Fc Control | Fold Increase Compared to CD112IgV-Fc | Fold Increase Compared to CD155 IgV-Fc | Fold Increase Compared to CD112IgV-Fc + CD155 IgV-Fc |
|---|---|---|---|---|---|---|
| (CD155 IgV) (G4S)2 Fc (G4S)3 (CD112 IgV) | 1260 | 6013 | 2.12 | 1.32 | 1.50 | 1.27 |
| (CD112 IgV) (G4S)2 Fc (G4S)3 (CD155 IgV) | 1261 | 3777 | 1.33 | 0.83 | 0.94 | 0.80 |
| (CD155 IgV) (G4S)3 (CD112 IgV) (G4S)2 Fc | 1262 | 3863 | 1.36 | 0.85 | 0.96 | 0.82 |
| (CD112 IgV) (G4S)3 (CD155 IgV) (G4S)2 Fc | 1263 | 3525 | 1.25 | 0.78 | 0.88 | 0.75 |
| Fc (G4S)3 (CD112 IgV) (G4S)3 (CD155 IgV) | 1264 | 3457 | 1.22 | 0.76 | 0.86 | 0.73 |
| non-stack variant CD112 IgV-Fc control | 1374 | 4542 | 1.60 | 1.00 | 1.13 | 0.96 |
| non-stack variant CD155 IgV-Fc control | 1271 | 4004 | 1.41 | 0.88 | 1.00 | 0.85 |
| CD112IgV-Fc + CD155 IgV-Fc | 1271 + 1374 | 4720 | 1.67 | 1.04 | 1.18 | 1.00 |
| Fc Control | 1119 | 2831 | 1.00 | 0.62 | 0.71 | 0.60 | concentration of 100, 25, or 6.25 nM. Jurkat cells and K562 cells were incubated for 5 hours at 37 degrees Celsius in a humidified 5% $CO_2$ incubation chamber. Plates are then removed from the incubator and acclimated to room temperature for 15 minutes. 100 µL of a cell lysis and luciferase substrate solution (BioGlo luciferase reagent, Promega) was added to each well and the plates were incubated on an Example 16

Assessment of Binding and Bioactivity of PD-L1/CD112/CD155 Stacked Affinity-Matured IgSF Domain-Containing Molecules This Example describes binding studies to assess specificity and affinity of PD-L1/CD112/CD155 stack immunomodulatory proteins (PD-L1/CD112/CD155 stacked IgV-Fc), generated in Example 13, for binding to cognate binding partners. In addition, a Jurkat/IL2/PD1/CD112R/TIGIT reporter assay was used to assess PD-1, CD112R, and TIGIT blocking activity of PD-L1/CD112/CD155 stacked IgV-Fc molecules. As a comparison, binding and blocking activity also was assessed of the non-stack variant PD-L1 IgV-Fc, CD112 IgV-Fc or CD155 IgV-Fc fusion molecules containing the same variant PD-L1 (SEQ ID NO:659), CD112 IgV (SEQ ID NO:1374) or variant CD155 IgV (SEQ ID NO:1271), respectively, used in the stacks.

A. Binding to Cell-Expressed Counter Structure

Binding studies were carried out using Jurkat/IL-2 reporter cells which endogenously express CD112R (purchased from Promega Corp. USA) that were transduced to stably express human PD-1 (Jurkat/PD-1 cells), human TIGIT (Jurkat/TIGIT cells) or both PD-1 and TIGIT (Jurkat/PD-1/TIGIT cells). For staining by flow cytometry, 100,000 Jurkat parental (CD112R), Jurkat/PD-1, Jurkat/TIGIT, Jurkat/PD-1/TIGIT cells were plated in 96-well round-bottom plates. Cells were spun down and resuspended in staining buffer (PBS (phosphate buffered saline), 1% BSA (bovine serum albumin), and 0.1% sodium azide) for 20 minutes to block non-specific binding. Afterwards, cells were centrifuged again and resuspended in 50 μL staining buffer containing 100 nM to 6 pM of each candidate Fc fusion protein. Primary staining was performed on ice for 90 minutes, before washing cells twice in 200 μL staining buffer. PE-conjugated anti-human Fc (Jackson ImmunoResearch, USA) was diluted 1:150 in 50 μL staining buffer and added to cells and incubated another 30 minutes on ice. Secondary antibody was washed out twice, cells were fixed in 4% formaldehyde/PBS, and samples were analyzed on an LSRII flow cytometer (Becton Dickinson Corp., USA).

Binding values, expressed as Mean Fluorescence Intensity (MFI), were determined for a 33.3 nM concentration of each stack Fc fusion protein and non-stack variant PD-L1 IgV-Fc, CD112-IgV-Fc and CD155-IgV-Fc proteins. Data was analyzed using FlowJo Version 10 software (FlowJo LLC, USA). Results for the binding studies for exemplary tested PD-L1/CD112/CD155 stack Fc fusion molecules (tested at 33.3 nM) are shown in Table 23. As shown, several stack proteins bound PD-1, TIGIT and/or CD112R with high affinity.

FBS) and anti-CD28 was added to a final concentration of 3 μg/mL. Jurkat cells were then plated at 50 μL/well for a total of 100,000 cells per well.

To each well, 25 μL of PD-L1/CD112/CD155 stacked IgV-Fc test protein was added to the Jurkat cells. As a control, non-stack variant PD-L1 IgV-Fc, CD112 IgV-Fc or CD155 IgV-Fc fusion molecules, alone or in combination, also were assessed for comparison. Anti-TIGIT antibody (clone MBSA43), anti-PD-1 antibody (nivolumab) or an empty Fc molecule are used as controls. All proteins were added at five concentrations: 400 nM, 100 nM, 25 nM, 6.25 nM, 1.56 nM, or 0.49 nM. The Jurkat cells with test or control proteins were incubated for 15 minutes at room temperature. CHO-derived artificial antigen presenting cells (aAPC) displaying transduced cell surface anti-CD3 single chain Fv (OKT3), PD-L1 and CD112 were brought to $0.8 \times 10^6$ cells/mL and 25 μL of cells was added to each well bringing the final volume of each well to 100 μL. Each well had a final ratio of 5:1 Jurkat:CHO cells and a test protein concentration of 100, 25, 6.25, 1.56, 0.47 or 0.12 nM and an anti-CD28 concentration of 1.5 μg/mL. Jurkat cells and CHO cells were incubated for 5 hours at 37 degrees Celsius in a humidified 5% $CO_2$ incubation chamber. Plates are then removed from the incubator and acclimated to room temperature for 15 minutes. 100 μL of a cell lysis and luciferase substrate solution (BioGlo luciferase reagent, Promega) was added to each well and the plates were incubated on an orbital shaker for 10 minutes. Luminescence was measured with a 1 second per well integration time using a BioTek Cytation luminometer.

An average relative luminescence value (RLU) was determined for each test sample and a fold increase (or decrease) in IL-2 reporter signal was calculated for each stack molecule compared to non-stack variant PD-L1 IgV-Fc, variant CD112 IgV-Fc and variant CD155 IgV-Fc proteins. Because the assay is a measure of blockade of inhibitory signals, an increase in luminescent signal compared to control indicates the presence of blocking activity.

As shown in Table 24, the luciferase activity of the Jurkat effector cells co-cultured with anti-CD3/PD-L1/CD112 aAPC and the PD-L1/CD112/CD155 stack Fc molecules was altered (increased) for each molecule tested. The differences in luminescence signals demonstrate the differ-

TABLE 23

| | | | Binding to Jurkat Transfectants | | | |
|---|---|---|---|---|---|---|
| Category | Description | SEQ ID NO | TIGIT | CD112R | PD1 | TIGIT/ CD112R/ PD1 |
| Stacks | (PD-L1 IgV) (G4S)3 (CD155 IgV) (G4S)3 (CD112 IgV) (G4S)2 Fc | 1267 | 2457 | 969 | 16989 | 19041 |
| | (PD-L1 IgV) (G4S)3 (CD112 IgV) (G4S)3 (CD155 IgV) (G4S)2 Fc | 1268 | 1504 | 289 | 21968 | 18727 |
| Controls | non-stack variant PD-L1 IgV-Fc control | 659 | 101 | 100 | 20713 | 18468 |
| | non-stack variant CD155 IgV-Fc control | 1271 | 6294 | 55 | 31 | 961 |
| | non-stack variant CD112 IgV-Fc control | 1374 | 358 | 516 | 459 | 477 |
| | Fc Control | 1119 | 23.3 | 27 | 22 | 35 |
| | | | | MFI at 33.3 nM | | |

Binding of Stacks to Cell-Expressed Counter Structure

B. Assessment of Bioactivity of Affinity-Matured IgSF Domain-Containing Molecules Jurkat effector cells expressing an IL-2-luciferase reporter and cell-surface PD-1, CD112R, and TIGIT were suspended at $2 \times 10^6$ cells/mL in Jurkat Assay buffer (RPMI1640+5% ences in binding of the PD-L1/CD112/CD155 stack-Fc molecules to PD-1, CD112R and TIGIT and the resulting co-blockade of inhibitory activity. In the Table, Column 1 sets forth the SEQ ID NO identifier for each PD-L1/CD112/CD155 stack-Fc variant tested.

TABLE 24

| | | | Fold Increase compared to Fc Control | Fold Increase compared to PD-L1 IgV-Fc | Fold Increase compared to CD155 IgV-Fc | Fold Increase compared to CD112-IgV -Fc |
|---|---|---|---|---|---|---|
| Description | SEQ ID NO | RLU | | | | |
| (PD-L1 IgV) (G4S)3 (CD155 IgV) (G4S)3 (CD112 IgV) (G4S)2 Fc | 1267 | 896 | 1.44 | 1.12 | 1.04 | 1.40 |
| (PD-L1 IgV) (G4S)3 (CD112 IgV) (G4S)3 (CD155 IgV) (G4S)2 Fc | 1268 | 961 | 1.54 | 1.20 | 1.12 | 1.50 |
| non-stack variant PD-L1 IgV-Fc control | 659 | 800 | 1.28 | 1.00 | 0.93 | 1.25 |
| non-stack variant CD155 IgV-Fc control | 1271 | 859 | 1.38 | 1.07 | 1.00 | 1.34 |
| non-stack variant CD112 IgV-Fc control | 1374 | 640 | 1.03 | 0.80 | 0.75 | 1.00 |
| Fc Control | 1119 | 624 | 1.00 | 0.78 | 0.73 | 0.98 |

The present invention is not intended to be limited in scope to the particular disclosed embodiments, which are provided, for example, to illustrate various aspects of the invention. Various modifications to the compositions and methods described will become apparent from the description and teachings herein. Such variations may be practiced without departing from the true scope and spirit of the disclosure and are intended to fall within the scope of the present disclosure.

SEQUENCE LISTING (2039 sequences)

SEQ ID NO: 1 - protein, 288 aa, Homo sapiens
  REGION 1..288: note = MISC_FEATURE - CD80(B7-1)
MGHTRRQGTSPSKCPYLNFFQLLVLAGLSHFCSGVIHVTKEVKEVATLSCGHNVSVEELAQTRIYWQKEKKMVLTMMSGDMNIWPEYKNRTIFDITNNLSIVILALRPSDEGTYECVVLKYEKDAFKREHLAEVTLSVKADFPTPSISDFEIPTSNIRRIICSTSGGFPEPHLSWLENGEELNAINTTVSQDPETELYAVSSKLDFNMTTNHSFMCLIKYGHLRVNQTFNWNTTKQEHFPDNLLPSWAITLISVNGIFVICCLTYCFAPRCRERRRNERLRRESVRPV

SEQ ID NO: 2 - protein, 329 aa, Homo sapiens
  REGION 1..329: note = MISC_FEATURE - CD86 (B7-2)
MDPQCTMGLSNILFVMAFLLSGAAPLKIQAYFNETADLPCQFANSQNQSLSELVVFWQDQENLVLNEVYLGKEKFDSVHSKYMGRTSFDSDSWTLRLHNLQIKDKGLYQCIIHHKKPTGMIRIHQMNSELSVLANFSQPEIVPISNITENVYINLTCSSIHGYPEPKKMSVLLRTKNSTIEYDGVMQKSQDNVTELYDVSISLSVSFPDVTSNMTIFCILETDKTRLLSSPFSIELEDPQPPPDHIPWITAVLPTVIICVMVFCLILWKWKKKKRPRNSYKCGTNTMEREESEQTKKREKIHIPERSDEAQRVFKSSKTSSCDKSDTCF

SEQ ID NO: 3 - protein, 290 aa, Homo sapiens
  REGION 1..290: note = MISC_FEATURE - CD274 (PD-L1, B7-H1)
MRIFAVFIFMTYWHLLNAFTVTVPKDLYVVEYGSNMTIECKFPVEKQLDLAALIVYWEMEDKNIIQFVHGEEDLKVQHSSYRQRARLLKDQLSLGNAALQITDVKLQDAGVYRCMISYGGADYKRITVKVNAPYNKINQRILVVDPVTSEHELTCQAEGYPKAEVIWTSSDHQVLSGKTTTTNSKREEKLFNVTSTLRINTTTNEIFYCTFRRLDPEENHTAELVIPELPLAHPPNERTHLVILGAILLCLGVALTFIFRLRKGRMMDVKKCGIQDTNSKKQSDTHLEET

SEQ ID NO: 4 - protein, 273 aa, Homo sapiens
  REGION 1..273: note = MISC_FEATURE - PDCD1LG2 (PD-L2, CD273)
MIFLLLMLSLELQLHQIAALFTVTVPKELYIIEHGSNVTLECNFDTGSHVNLGAITASLQKVENDTSPHRERATLLEEQLPLGKASFHIPQVQVRDEGQYQCIIIYGVAWDYKYLTLKVKASYRKINTHILKVPETDEVELTCQATGYPLAEVSWPNVSVPANTSHSRTPEGLYQVTSVLRLKPPPGRNFSCVFWNTHVRELTLASIDLQSQMEPRTHPTWLLHIFIPFCIIAFIFIATVIALRKQLCQKLYSSKDTTKRPVTTTKREVNSAI

SEQ ID NO: 5 - protein, 302 aa, Homo sapiens
  REGION 1..302: note = MISC_FEATURE - ICOSLG (B7RP1, CD275, ICOSL, B7-H2)
MRLGSPGLLFLLFSSLRADTQEKEVRAMVGSDVELSCACPEGSRFDLNDVYVYWQTSESKTVVTYHIPQNSSLENVDSRYRNRALMSPAGMLRGDFSLRLFNVTPQDEQKFHCLVLSQSLGFQEVLSVEVTLHVAANFSVPVVSAPHSPSQDELTFTCTSINGYPRPNVYWINKTDNSLLDQALQNDTVFLNMRGLYDVVSVLRIARTPSVNIGCCIENVLLQQNLTVGSQTGNDIGERDKITENPVSTGEKNAATWSILAVLCLLVVVAVAIGWVCRDRCLQHSYAGAWAVSPETELTGHV

SEQ ID NO: 6 - protein, 534 aa, Homo sapiens
  REGION 1..534: note = MISC_FEATURE - CD276 (B7-H3)
MLRRRGSPGMGVHVGAALGALWFCLTGALEVQVPEDPVVALVGTDATLCCSFSPEPGFSLAQLNLIWQLTDTKQLVHSFAEGQDQGSAYANRTALFPDLLAQGNASLRLQRVRVADEGSFTCFVSIRDFGSAAVSLQVAAPYSKPSMTLEPNKDLRPGDTVTITCSSYQGYPEAEVFWQDGQGVPLTGNVTTSQMANEQGLFDVHSILRVVLGANGTYSCLVRNPVLQQDAHSSVTITPQRSPTGAVEVQVPEDPVVALVGTDATLRCSFSPEPGFSLAQLNLIWQLTDTKQLVHSFTEGRDQGSAYANRTALFPDLLAQGNASLRLQRVRVADEGSFTCFVSIRDFGSAAVSLQVAAPYSKPSMTLEPNKDLRPGDTVTITCSSYRGYPEAEVFWQDGQGVPLTGNVTTSQMANEQGLFDVHSVLRVVLGANGTYSCLVRNPVLQQDAHGSVTITGQPMTFPPEALWVTVGLSVCLIALLVALAFVCWRKIKQSCEEENAGAEDQDGEGEGSKTALQPLKHSDSKEDDGQEIA

SEQ ID NO: 7 - protein, 282 aa, Homo sapiens
  REGION 1..282: note = MISC_FEATURE - VTCN1 (B7-H4)
MASLGQILFWSIISIIIILAGAIALIIGFGISGRHSITVTTVASAGNIGEDGILSCTFEPDIKLSDIVIQWLKEGVLGLVHEFKEGKDELSEQDEMFRGRTAVFADQVIVGNASLRLKNVQLTDAGTYKCYIITSKGKGNANLEYKTGAFSMPEVNVDYNASSETLRCEAPRWFPQPTVVWASQVDQGANFSEVSNTSFELNSENVTMKVVSVLYNVTINNTYSCMIENDIAKATGDIKVTESEIKRRSHLQLLNSKASLCVSSFFAISWALLPLSPYLMLK

SEQ ID NO: 8 - protein, 220 aa, Homo sapiens
  REGION 1..220: note = MISC_FEATURE - CD28
MLRLLLALNLFPSIQVTGNKILVKQSPMLVAYDNAVNLSCKYSYNLFSREFRASLHKGLDSAVEVCVVYGNYSQQLQVYSKTGFNCDGKLGNESVTFYLQNLYVNQTDIYFCKIEVMYPPPYLDNEKSNGTIIHVKGKHLCPSPLFPGPSKPFWVLVVVGGVLACYSLLVTVAFIIFWVRSKRSRLLHSDYMNMTPRRPGPTRKHYQPYAPPRDFAAYRS

SEQ ID NO: 9 - protein, 223 aa, Homo sapiens
  REGION 1..223: note = MISC_FEATURE - CTLA4
MACLGFQRHKAQLNLATRTWPCTLLFFLLFIPVFCKAMHVAQPAVVLASSRGIASFVCEYASPGKATEVRVTVLRQADSQVTEVCAATYMMGNELTFLDDSICTGTSSGNQVNLTIQGLRAMDTGLYICKVELMYPPPYYLGIGNGTQIYVIDPEPCPDSDFLLWILAAVSSGLFFYSFLLTAVSLSKMLKKRSPLTTGVYVKMPPTEPECEKQFQPYFIPIN

SEQ ID NO: 10 - protein, 288 aa, Homo sapiens
  REGION 1..288: note = MISC_FEATURE - PDCD1 (PD-1)
MQIPQAPWPVVWAVLQLGWRPGWFLDSPDRPWNPPTFSPALLVVTEGDNATFTCSFSNTSESFVLNWYRMSPSNQTDKLAAFPEDRSQPGQDCRFRVTQLPNGRDFHMSVVRARRNDSGTYLCGAISLAPKAQIKESLRAELRVTERRAEVPTAHPSPSPRPAGQFQTLVVGVVGGLLGSLVLLVWVLAVICSRAARGTIGARRTGQPLKEDPSAVPVFSVDYGELDFQWREKTPEPPVPCVPEQTEYATIVFPSGMGTSSPARRGSADGPRSAQPLRPEDGHCSWPL

SEQ ID NO: 11 - protein, 199 aa, Homo sapiens
  REGION 1..199: note = MISC_FEATURE - ICOS
MKSGLWYFFLFCLRIKVLTGEINGSANYEMFIFHNGGVQILCKYPDIVQQFKMQLLKGGQILCDLTKTKGSGNTVSIKSLKFCHSQLSNNSVSFFLYNLDHSHANYYFCNLSIFDPPPFKVTLTGGYLHIYESQLCCQLKFWLPIGCAAFVVVCILGCILICWLTKKKYSSSVHDPNGEYMFMRAVNTAKKSRLTDVTL

SEQ ID NO: 12 - protein, 289 aa, Homo sapiens
  REGION 1..289: note = MISC_FEATURE - BTLA (CD272)
MKTLPAMLGTGKLFWVFFLIPYLDIWNIHGKESCDVQLYIKRQSEHSILAGDPFELECPVKYCANRPHVTWCKLNGTTCVKLEDRQTSWKEEKNISFFILHFEPVLPNDNGSYRCSANFQSNLIESHSTTLYVTDVKSASERPSKDEMASRPWLLYRLLPLGGLPLLITTCFCLFCCLRRHQGKQNELSDTAGREINLVDAHLKSEQTEASTRQNSQVLLSETGIYDNDPDLCFRMQEGSEVYSNPCLEENKPGIVYASLNHSVIGPNSRLARNVKEAPTEYASICVRS

SEQ ID NO: 13 - protein, 458 aa, Homo sapiens
  REGION 1..458: note = MISC_FEATURE - CD4
MNRGVPFRHLLLVLQLALLPAATQGKKVVLGKKGDTVELTCTASQKKSIQFHWKNSNQIKILGNQGSFLTKGPSKLNDRADSRRSLWDQGNFPLIIKNLKIEDSDTYICEVEDQKEEVQLLVFGLTANSDTHLLQGQSLTLTLESPPGSSPSVQCRSPRGKNIQGGKTLSVSQLELQDSGTWTCTVLQNQKKVEFKIDIVVLAFQKASSIVYKKEGEQVEFSFPLAFTVEKLTGSGELWWQAERASSSKSWITFDLKNKEVSVKRVTQDPKLQMGKKLPLHLTLPQALPQYAGSGNLTLALEAKTGKLHQEVNLVVMRATQLQKNLTCEVWGPTSPKLMLSLKLENKEAKVSKREKAVWVLNPEAGMWQCLLSDSGQVLLESNIKVLPTWSTPVQPMALIVLGGVAGLLLFIGLGIFFCVRCRHRRRQAERMSQIKRLLSEKKTCQCPHRFQKTCSPI

SEQ ID NO: 14 - protein, 235 aa, Homo sapiens
  REGION 1..235: note = MISC_FEATURE - CD8A (CD8-alpha)
MALPVTALLLPLALLLHAARPSQFRVSPLDRTWNLGETVELKCQVLLSNPTSGCSWLFQPRGAAASPTFLLYLSQNKPKAAEGLDTQRFSGKRLGDTFVLTLSDFRRENEGYYFCSALSNSIMYFSHFVPVFLPAKPTTTPAPRPPTPAPTIASQPLSLRPEACRPAAGGAVHTRGLDFACDIYIWAPLAGTCGVLLLSLVITLYCNHRNRRRVCKCPRPVVKSGDKPSLSARYV

SEQ ID NO: 15 - protein, 210 aa, Homo sapiens
  REGION 1..210: note = MISC_FEATURE - CD8B (CD8-beta)
MRPRLWLLLAAQLTVLHGNSVLQQTPAYIKVQTNKMVMLSCEAKISLSNMRIYWLRQRQAPSSDSHHEFLALWDSAKGTIHGEEVEQEKIAVFRDASRFILNLTSVKPEDSGIYFCMIVGSPELTFGKGTQLSVVDFLPTTAQPTKKSTLKKRVCRLPRPETQKGPLCSPITLGLLVAGVLVLLVSLGVAIHLCCRRRRARLRFMKQFYK

SEQ ID NO: 16 - protein, 525 aa, Homo sapiens
  REGION 1..525: note = MISC_FEATURE - LAG3
MWEAQFLGLLFLQPLWVAPVKPLQPGAEVPVVWAQEGAPAQLPCSPTIPLQDLSLLRRAGVTWQHQPDSGPPAAAPGHPLAPGPHPAAPSSWGPRPRRYTVLSVGPGGLRSGRLPLQPRVQLDERGRQRGDFSLWLRPARRADAGEYRAAVHLRDRALSCRLRLRLGQASMTASPPGSLRASDWVILNCSFSRPDRPASVHWFRNRGQGRVPVRESPHHHLAESFLFLPQVSPMDSGPWGCILTYRDGFNVSIMYNLTVLGLEPPTPLTVYAGAGSRVGLPCRLPAGVGTRSFLTAKWTPPGGGPDLLVTGDNGDFTLRLEDVSQAQAGTYTCHIHLQEQQLNATVTLAIITVTPKSFGSPGSLGKLLCEVTPVSGQERFVWSSLDTPSQRSFSGPWLEAQEAQLLSQPWQCQLYQGERLLGAAVYFTELSSPGAQRSGRAPGALPAGHLLLFLILGVLSLLLLVTGAFGFHLWRRQWRPRRFSALEQGIHPPQAQSKIEELEQEPEPEPEPEPEPEPEPEPEQL

SEQ ID NO: 17 - protein, 301 aa, Homo sapiens
  REGION 1..301: note = MISC_FEATURE - HAVCR2 (TIM-3)
MFSHLPFDCVLLLLLLLLTRSSEVEYRAEVGQNAYLPCFYTPAAPGNLVPVCWGKGACPVFECGNVVLRTDERDVNYWTSRYWLNGDFRKGDVSLTIENVTLADSGIYCCRIQIPGIMNDEKFNLKLVIKPAKVTPAPTRQRDFTAAFPRMLTTRGHGPAETQTLGSLPDINLTQISTLANELRDSRLANDLRDSGATIRIGIYIGAGICAGLALALIFGALIFKWYSHSKEKIQNLSLISLANLPPSGLANAVAEGIRSEENIYTIEENVYEVEEPNEYYCYVSSRQQPSQPLGCRFAMP

SEQ ID NO: 18 - protein, 526 aa, Homo sapiens
  REGION 1..526: note = MISC_FEATURE - CEACAM1
MGHLSAPLHRVRVPWQGLLLTASLLTFWNPPTTAQLTTESMPFNVAEGKEVLLLVHNLPQQLFGYSWYKGERVDGNRQIVGYAIGTQQATPGPANSGRETIYPNASLLIQNVTQNDTGFYTLQVIKSDLVNEEATGQFHVYPELPKPSISSNNSNPVEDKDAVAFTCEPETQDTTYLWWINNQSLPVSPRLQLSNGNRTLTLLSVTRNDTGPYECEIQNPVSANRSDPVTLNVTYGPDTPTISPSDTYYRPGANLSLSCYAASNPPAQYSWLINGTFQQSTQELFIPNITVNNSGSYTCHANNSVTGCNRTTVKTIIVTELSPVVAKPQIKASKTTVTGDKDSVNLTCSTNDTGISIRWFFKNQSLPSSERMKLSQGNTTLSINPVKREDAGTYWCEVFNPISKNQSDPIMLNVNYNALPQENGLSPGAIAGIVIGVVALVALIAVALACFLHFGKTGRASDQRDLTEHKPSVSNHTQDHSNDPPNKMNEVTYSTLNFEAQQPTQPTSASPSLTATEIIYSEVKKQ

SEQ ID NO: 19 - protein, 244 aa, Homo sapiens
  REGION 1..244: note = MISC_FEATURE - TIGIT
MRWCLLLIWAQGLRQAPLASGMMTGTIETTGNISAEKGGSIILQCHLSSTTAQVTQVNWEQQDQLLAICNADLGWHISPSFKDRVAPGPGLGLTLQSLTVNDTGEYFCIYHTYPDGTYTGRIFLEVLESSVAEHGARFQIPLLGAMAATLVVICTAVIVVVALTRKKKALRIHSVEGDLRRKSAGQEEWSPSAPSPPGSCVQAEAAPAGLCGEQRGEDCAELHDYFNVLSYRSLGNCSFFTETG

SEQ ID NO: 20 - protein, 417 aa, Homo sapiens
  REGION 1..417: note = MISC_FEATURE - PVR (CD155)
MARAMAAAWPLLLVALLVLSWPPPGTGDVVVQAPTQVPGFLGDSVTLPCYLQVPNMEVTHVSQLTWARHGESGSMAVFHQTQGPSYSESKRLEFVAARLGAELRNASLRMFGLRVEDEGNYTCLFVTFPQGSRSVDIWLRVLAKPQNTAEVQKVQLTGEPVPMARCVSTGGRPPAQITWHSDLGGMPNTSQVPGFLSGTVTVTSLWILVPSSQVDGKNVTCKVEHESFEKPQLLTVNLTVYYPPEVSISGYDNNWYLGQNEATLTCDARSNPEPTGYNWSTTMGPLPPFAVAQGAQLLIRPVDKPINTTLICNVTNALGARQAELTVQVKEGPPSEHSGISRNAIIFLVLGILVFLILLGIGIYFYWSKCSREVLWHCHLCPSSTEHASASANGHVSYSAVSRENSSSQDPQTEGTR

SEQ ID NO: 21 - protein, 538 aa, Homo sapiens
  REGION 1..538: note = MISC_FEATURE - PVRL2 (CD112)
MARAAALLPSRSPPTPLLWPLLLLLLLETGAQDVRVQVLPEVRGQLGGTVELPCHLLPPVPGLYISLVTWQRPDAPANHQNVAAFHPKMGPSFPSPKPGSERLSFVSAKQSTGQDTEAELQDATLALHGLTVEDEGNYTCEFATFPKGSVRGMTWLRVIAKPKNQAEAQKVTFSQDPTTVALCISKEGRPPARISWLSSLDWEAKETQVSGTLAGTVTVTSRFTLVPSGRADGVTVTCKVEHESFEEPALIPVTLSVRYPPEVSISGYDDNWYLGRTDATLSCDVRSNPEPTGYDWSTTSGTFPTSAVAQGSQLVIHAVDSLFNTTFVCTVTNAVGMGRAEQVIFVRETPNTAGAGATGGIIGGIIAAIIATAVAATGILICRQQRKEQTLQGAEEDEDLEGPPSYKPPTPKAKLEAQEMPSQLFTLGASEHSPLKTPYFDAGASCTEQEMPRYHELPTLEERSGPLHPGATSLGSPIPVPPGPPAVEDVSLDLEDEEGEEEEEYLDKINPIYDALSYSSPSDSYQGKGFVMSRAMYV

SEQ ID NO: 22 - protein, 336 aa, Homo sapiens
  REGION 1..336: note = MISC_FEATURE - CD226
MDYPTLLLALLHVYRALCEEVLWHTSVPFAENMSLECVYPSMGILTQVEWFKIGTQQDSIAIFSPTHGMVIRKPYAERVYFLNSTMASNNMTLFFRNASEDDVGYYSCSLYTYPQGTWQKVIQVVQSDSFEAAVPSNSHIVSEPGKNVTLTCQPQMTWPVQAVRWEKIQPRQIDLLTYCNLVHGRNFTSKFPRQIVSNCSHGRWSVIVIPDVTVSDSGLYRCYLQASAGENETFVMRLTVAEGKTDNQYTLFVAGGTVLLLLFVISITTIIVIFLNRRRRRERRDLFTESWDTQKAPNNYRSPISTSQPTNQSMDDTREDIYVNYPTFSRRPKTRV

SEQ ID NO: 23 - protein, 351 aa, Homo sapiens
  REGION 1..351: note = MISC_FEATURE - CD2
MSFPCKFVASFLLIFNVSSKGAVSKEITNALETWGALGQDINLDIPSFQMSDDIDDIKWEKTSDKKKIAQFRKEKETFKEKDTYKLFKNGTLKIKHLKTDDQDIYKVSIYDTKGKNVLEKIFDLKIQERVSKPKISWTCINTTLTCEVMNGTDPELNLYQDGKHLKLSQRVITHKWTTSLSAKFKCTAGNKVSKESSVEPVSCPEKGLDIYLIIGICGGGSLLMVFVALLVFYITKRKKQRSRRNDEELETRAHRVATEERGRKPHQIPASTPQNPATSQHPPPPPGHRSQAPSHRPPPPGHRVQHQPQKRPPAPSGTQVHQQKGPPLPRPRVQPKPPHGAAENSLSPSSN

SEQ ID NO: 24 - protein, 180 aa, Homo sapiens
  REGION 1..180: note = MISC_FEATURE - CD160
MLLEPGRGCCALAILLAIVDIQSGGCINITSSASQEGTRLNLICTVWHKKEEAEGFVVFLCKDRSGDCSPETSLKQLRLKRDPGIDGVGEISSQLMFTISQVTPLHSGTYQCCARSQKSGIRLQGHFFSILFTETGNYTVTGLKQRQHLEFSHNEGTLSSGFLQEKVWVMLVTSLVALQA

SEQ ID NO: 25 - protein, 278 aa, Homo sapiens
  REGION 1..278: note = MISC_FEATURE - CD200
MERLVIRMPFSHLSTYSLVWVMAAVVLCTAQVQVVTQDEREQLYTPASLKCSLQNAQEALIVTWQKKKAVSPENMVTFSENHGVVIQPAYKDKINITQLGLQNSTITFWNITLEDEGCYMCLFNTFGFGKISGTACLTVYVQPIVSLHYKFSEDHLNITCSATARPAPMVFWKVPRSGIENSTVTLSHPNGTTSVTSILHIKDPKNQVGKEVICQVLHLGTVTDFKQTVNKGYWFSVPLLLSIVSLVILLVLISILLYWKRHRNQDRGELSQGVQKMT

SEQ ID NO: 26 - protein, 325 aa, Homo sapiens [sequence omitted]

SEQ ID NO: 27 - protein, 201 aa, Homo sapiens
  REGION 1..201: note = MISC_FEATURE - NC R3 (NKp30)
MAWMLLLILIMVHPGSCALWVSQPPEIRTLEGSSAFLPCSFNASQGRLAIGSVTWFRDEVVPGKEVRNGTPEFRGRLAPLASSRFLHDHQAELHIRDVRGHDASIYVCRVEVLGLGVGTGNGTRLVVEKEHPQLGAGTVLLLRAGFYAVSFLSVAVGSTVYYQGKCLTWKGPRRQLPAVVPAPLPPPCGSSAHLLPPVPGG

SEQ ID NO: 28 - protein, 208 aa, Homo sapiens [sequence omitted]

SEQ ID NO: 29 - protein, 224 aa, Homo sapiens
  REGION 1..224: note = MISC_FEATURE - CD86(B7-2) ECD
APLKIQAYFNETADLPCQFANSQNQSLSELVVFWQDQENLVLNEVYLGKEKFDSVHSKYMGRTSFDSDSWTLRLHNLQIKDKGLYQCIIHHKKPTGMIRIHQMNSELSVLANFSQPEIVPISNITENVYINLTCSSIHGYPEPKKMSVLLRTKNSTIEYDGVMQKSQDNVTELYDVSISLSVSFPDVTSNMTIFCILETDKTRLLSSPFSIELEDPQPPPDHIP

SEQ ID NO: 30 - protein, 220 aa, Homo sapiens
  REGION 1..220: note = MISC_FEATURE - CD274 (PD-L1, B7-H1) ECD
FTVTVPKDLYVVEYGSNMTIECKFPVEKQLDLAALIVYWEMEDKNIIQFVHGEEDLKVQHSSYRQRARLLKDQLSLGNAALQITDVKLQDAGVYRCMISYGGADYKRITVKVNAPYNKINQRILVVDPVTSEHELTCQAEGYPKAEVIWTSSDHQVLSGKTTTTNSKREEKLFNVTSTLRINTTTNEIFYCTFRRLDPEENHTAELVIPELPLAHPPNER

SEQ ID NO: 31 - protein, 201 aa, Homo sapiens
  REGION 1..201: note = MISC_FEATURE - PDCD1LG2 (PD-L2, CD273) ECD
LFTVTVPKELYIIEHGSNVTLECNFDTGSHVNLGAITASLQKVENDTSPHRERATLLEEQLPLGKASFHIPQVQVRDEGQYQCIIIYGVAWDYKYLTLKVKASYRKINTHILKVPETDEVELTCQATGYPLAEVSWPNVSVPANTSHSRTPEGLYQVTSVLRLKPPPGRNFSCVFWNTHVRELTLASIDLQSQMEPRTHPT

SEQ ID NO: 32 - protein, 238 aa, Homo sapiens [sequence omitted]

SEQ ID NO: 33 - protein, 438 aa, Homo sapiens
  REGION 1..438: note = MISC_FEATURE - CD276 (B7-H3) ECD
LEVQVPEDPVVALVGTDATLCCSFSPEPGFSLAQLNLIWQLTDTKQLVHSFAEGQDQGSAYANRTALFPDLLAQGNASLRLQRVRVADEGSFTCFVSIRDFGSAAVSLQVAAPYSKPSMTLEPNKDLRPGDTVTITCSSYQGYPEAEVFWQDGQGVPLTGNVTTSQMANEQGLFDVHSILRVVLGANGTYSCLVRNPVLQQDAHSSVTITPQRSPTGAVEVQVPEDPVVALVGTDATLRCSFSPEPGFSLAQLNLIWQLTDTKQLVHSFTEGRDQGSAYANRTALFPDLLAQGNASLRLQRVRVADEGSFTCFVSIRDFGSAAVSLQVAAPYSKPSMTLEPNKDLRPGDTVTITCSSYRGYPEAEVFWQDGQGVPLTGNVTTSQMANEQGLFDVHSVLRVVLGANGTYSCLVRNPVLQQDAHGSVTITGQPMTFPPEA

SEQ ID NO: 34 - protein, 235 aa, Homo sapiens
  REGION 1..235: note = MISC_FEATURE - VTCN1(B7-H4) ECD
LIIGFGISGRHSITVTTVASAGNIGEDGILSCTFEPDIKLSDIVIQWLKEGVLGLVHEFKEGKDELSEQDEMFRGRTAVFADQVIVGNASLRLKNVQLTDAGTYKCYIITSKGKGNANLEYKTGAFSMPEVNVDYNASSETLRCEAPRWFPQPTVVWASQVDQGANFSEVSNTSFELNSENVTMKVVSVLYNVTINNTYSCMIENDIAKATGDIKVTESEIKRRSHLQLLNSKAS

SEQ ID NO: 35 - protein, 134 aa, Homo sapiens
  REGION 1..134: note = MISC_FEATURE - CD28 ECD
NKILVKQSPMLVAYDNAVNLSCKYSYNLFSREFRASLHKGLDSAVEVCVVYGNYSQQLQVYSKTGFNCDGKLGNESVTFYLQNLYVNQTDIYFCKIEVMYPPPYLDNEKSNGTIIHVKGKHLCPSPLFPGPSKP

SEQ ID NO: 36 - protein, 126 aa, Homo sapiens [sequence omitted]

SEQ ID NO: 37 - protein, 150 aa, Homo sapiens [sequence omitted]

SEQ ID NO: 38 - protein, 120 aa, Homo sapiens
  REGION 1..120: note = MISC_FEATURE - ICOS ECD
EINGSANYEMFIFHNGGVQILCKYPDIVQQFKMQLLKGGQILCDLTKTKGSGNTVSIKSLKFCHSQLSNNSVSFFLYNLDHSHANYYFCNLSIFDPPPFKVTLTGGYLHIYESQLCCQLK

SEQ ID NO: 39 - protein, 127 aa, Homo sapiens
  REGION 1..127: note = MISC_FEATURE - BTLA (CD272) ECD
KESCDVQLYIKRQSEHSILAGDPFELECPVKYCANRPHVTWCKLNGTTCVKLEDRQTSWKEEKNISFFILHFEPVLPNDNGSYRCSANFQSNLIESHSTTLYVTDVKSASERPSKDEMASRPWLLYR

SEQ ID NO: 40 - protein, 371 aa, Homo sapiens
  REGION 1..371: note = MISC_FEATURE - CD4 ECD
KKVVLGKKGDTVELTCTASQKKSIQFHWKNSNQIKILGNQGSFLTKGPSKLNDRADSRRSLWDQGNFPLIIKNLKIEDSDTYICEVEDQKEEVQLLVFGLTANSDTHLLQGQSLTLTLESPPGSSPSVQCRSPRGKNIQGGKTLSVSQLELQDSGTWTCTVLQNQKKVEFKIDIVVLAFQKASSIVYKKEGEQVEFSFPLAFTVEKLTGSGELWWQAERASSSKSWITFDLKNKEVSVKRVTQDPKLQMGKKLPLHLTLPQALPQYAGSGNLTLALEAKTGKLHQEVNLVVMRATQLQKNLTCEVWGPTSPKLMLSLKLENKEAKVSKREKAVWVLNPEAGMWQCLLSDSGQVLLESNIKVLPTWSTPVQP

SEQ ID NO: 41 - protein, 161 aa, Homo sapiens
  REGION 1..161: note = MISC_FEATURE - CD8A (CD8-alpha) ECD
SQFRVSPLDRTWNLGETVELKCQVLLSNPTSGCSWLFQPRGAAASPTFLLYLSQNKPKAAEGLDTQRFSGKRLGDTFVLTLSDFRRENEGYYFCSALSNSIMYFSHFVPVFLPAKPTTTPAPRPPTPAPTIASQPLSLRPEACRPAAGGAVHTRGLDFACD

SEQ ID NO: 42 - protein, 149 aa, Homo sapiens
  REGION 1..149: note = MISC_FEATURE - CD8B (CD8-beta) ECD
LQQTPAYIKVQTNKMVMLSCEAKISLSNMRIYWLRQRQAPSSDSHHEFLALWDSAKGTIHGEEVEQEKIAVFRDASRFILNLTSVKPEDSGIYFCMIVGSPELTFGKGTQLSVVDFLPTTAQPTKKSTLKKRVCRLPRPETQKGPLCSP

SEQ ID NO: 43 - protein, 422 aa, Homo sapiens
  REGION 1..422: note = MISC_FEATURE - LAG3 ECD
VPVVWAQEGAPAQLPCSPTIPLQDLSLLRRAGVTWQHQPDSGPPAAAPGHPLAPGPHPAAPSSWGPRPRRYTVLSVGPGGLRSGRLPLQPRVQLDERGRQRGDFSLWLRPARRADAGEYRAAVHLRDRALSCRLRLRLGQASMTASPPGSLRASDWVILNCSFSRPDRPASVHWFRNRGQGRVPVRESPHHHLAESFLFLPQVSPMDSGPWGCILTYRDGFNVSIMYNLTVLGLEPPTPLTVYAGAGSRVGLPCRLPAGVGTRSFLTAKWTPPGGGPDLLVTGDNGDFTLRLEDVSQAQAGTYTCHIHLQEQQLNATVTLAIITVTPKSFGSPGSLGKLLCEVTPVSGQERFVWSSLDTPSQRSFSGPWLEAQEAQLLSQPWQCQLYQGERLLGAAVYFTELSSPGAQRSGRAPGALPAGHL

SEQ ID NO: 44 - protein, 181 aa, Homo sapiens
  REGION 1..181: note = MISC_FEATURE - HAVCR2 (TIM-3) ECD
SEVEYRAEVGQNAYLPCFYTPAAPGNLVPVCWGKGACPVFECGNVVLRTDERDVNYWTSRYWLNGDFRKGDVSLTIENVTLADSGIYCCRIQIPGIMNDEKFNLKLVIKPAKVTPAPTRQRDFTAAFPRMLTTRGHGPAETQTLGSLPDINLTQISTLANELRDSRLANDLRDSGATIRIG

SEQ ID NO: 45 - protein, 394 aa, Homo sapiens
  REGION 1..394: note = MISC_FEATURE - CEACAM1 ECD
QLTTESMPFNVAEGKEVLLLVHNLPQQLFGYSWYKGERVDGNRQIVGYAIGTQQATPGPANSGRETIYPNASLLIQNVTQNDTGFYTLQVIKSDLVNEEATGQFHVYPELPKPSISSNNSNPVEDKDAVAFTCEPETQDTTYLWWINNQSLPVSPRLQLSNGNRTLTLLSVTRNDTGPYECEIQNPVSANRSDPVTLNVTYGPDTPTISPSDTYYRPGANLSLSCYAASNPPAQYSWLINGTFQQSTQELFIPNITVNNSGSYTCHANNSVTGCNRTTVKTIIVTELSPVVAKPQIKASKTTVTGDKDSVNLTCSTNDTGISIRWFFKNQSLPSSERMKLSQGNTTLSINPVKREDAGTYWCEVFNPISKNQSDPIMLNVNYNALPQENGLSPG

SEQ ID NO: 46 - protein, 120 aa, Homo sapiens
  REGION 1..120: note = MISC_FEATURE - TIGIT ECD
MMTGTIETTGNISAEKGGSIILQCHLSSTTAQVTQVNWEQQDQLLAICNADLGWHISPSFKDRVAPGPGLGLTLQSLTVNDTGEYFCIYHTYPDGTYTGRIFLEVLESSVAEHGARFQIP

SEQ ID NO: 47 - protein, 323 aa, Homo sapiens
  REGION 1..323: note = MISC_FEATURE - PVR (CD155) ECD
WPPPGTGDVVVQAPTQVPGFLGDSVTLPCYLQVPNMEVTHVSQLTWARHGESGSMAVFHQTQGPSYSESKRLEFVAARLGAELRNASLRMFGLRVEDEGNYTCLFVTFPQGSRSVDIWLRVLAKPQNTAEVQKVQLTGEPVPMARCVSTGGRPPAQITWHSDLGGMPNTSQVPGFLSGTVTVTSLWILVPSSQVDGKNVTCKVEHESFEKPQLLTVNLTVYYPPEVSISGYDNNWYLGQNEATLTCDARSNPEPTGYNWSTTMGPLPPFAVAQGAQLLIRPVDKPINTTLICNVTNALGARQAELTVQVKEGPPSEHSGISRN

SEQ ID NO: 48 - protein, 329 aa, Homo sapiens
  REGION 1..329: note = MISC_FEATURE - PVRL2 (CD112) ECD
QDVRVQVLPEVRGQLGGTVELPCHLLPPVPGLYISLVTWQRPDAPANHQNVAAFHPKMGPSFPSPKPGSERLSFVSAKQSTGQDTEAELQDATLALHGLTVEDEGNYTCEFATFPKGSVRGMTWLRVIAKPKNQAEAQKVTFSQDPTTVALCISKEGRPPARISWLSSLDWEAKETQVSGTLAGTVTVTSRFTLVPSGRADGVTVTCKVEHESFEEPALIPVTLSVRYPPEVSISGYDDNWYLGRTDATLSCDVRSNPEPTGYDWSTTSGTFPTSAVAQGSQLVIHAVDSLFNTTFVCTVTNAVGMGRAEQVIFVRETPNTAGAGATGG

SEQ ID NO: 49 - protein, 236 aa, Homo sapiens [sequence omitted]

SEQ ID NO: 50 - protein, 185 aa, Homo sapiens
  REGION 1..185: note = MISC_FEATURE - CD2 ECD
KEITNALETWGALGQDINLDIPSFQMSDDIDDIKWEKTSDKKKIAQFRKEKETFKEKDTYKLFKNGTLKIKHLKTDDQDIYKVSIYDTKGKNVLEKIFDLKIQERVSKPKISWTCINTTLTCEVMNGTDPELNLYQDGKHLKLSQRVITHKWTTSLSAKFKCTAGNKVSKESSVEPVSCPEKGLD

SEQ ID NO: 51 - protein, 133 aa, Homo sapiens
  REGION 1..133: note = MISC_FEATURE - CD160 ECD
INITSSASQEGTRLNLICTVWHKKEEAEGFVVFLCKDRSGDCSPETSLKQLRLKRDPGIDGVGEISSQLMFTISQVTPLHSGTYQCCARSQKSGIRLQGHFFSILFTETGNYTVTGLKQRQHLEFSHNEGTLS

SEQ ID NO: 52 - protein, 202 aa, Homo sapiens
  REGION 1..202: note = MISC_FEATURE - CD200 ECD
QVQVVTQDEREQLYTPASLKCSLQNAQEALIVTWQKKKAVSPENMVTFSENHGVVIQPAYKDKINITQLGLQNSTITFWNITLEDEGCYMCLFNTFGFGKISGTACLTVYVQPIVSLHYKFSEDHLNITCSATARPAPMVFWKVPRSGIENSTVTLSHPNGTTSVTSILHIKDPKNQVGKEVICQVLHLGTVTDFKQTVNKG

SEQ ID NO: 53 - protein, 215 aa, Homo sapiens
  REGION 1..215: note = MISC_FEATURE - CD200R1 (CD200R) ECD
MDEKQITQNYSKVLAEVNTSWPVKMATNAVLCCPPIALRNLIIITWEIILRGQPSCTKAYRKETNETKETNCTDERITWVSRPDQNSDLQIRPVAITHDGYYRCIMVTPDGNFHRGYHLQVLVTPEVTLFQNRNRTAVCKAVAGKPAAQISWIPEGDCATKQEYWSNGTVTVKSTCHWEVHNVSTVTCHVSHLTGNKSLYIELLPVPGAKKSAKL

SEQ ID NO: 54 - protein, 117 aa, Homo sapiens
  REGION 1..117: note = MISC_FEATURE - NC R3 (NKp30) ECD
LWVSQPPEIRTLEGSSAFLPCSFNASQGRLAIGSVTWFRDEVVPGKEVRNGTPEFRGRLAPLASSRFLHDHQAELHIRDVRGHDASIYVCRVEVLGLGVGTGNGTRLVVEKEHPQLG

SEQ ID NO: 55 - protein, 19 aa, Homo sapiens
  REGION 1..19: note = MISC_FEATURE - VH signal peptide
MGSTAILALLLAVLQGVSA

SEQ ID NO: 56 - protein, 232 aa, Homo sapiens
  REGION 1..232: note = MISC_FEATURE - IgG1 Fc
EPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 57 - protein, 235 aa, Homo sapiens
  REGION 1..235: note = MISC_FEATURE - IgG2 Fc
TKVDKTVERKCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGK

SEQ ID NO: 58 - protein, 116 aa, Homo sapiens
  REGION 1..116: note = MISC_FEATURE - CD155 IgV
PGTGDVVVQAPTQVPGFLGDSVTLPCYLQVPNMEVTHVSQLTWARHGESGSMAVFHQTQGPSYSESKRLEFVAARLGAELRNASLRMFGLRVEDEGNYTCLFVTFPQGSRSVDIWL

SEQ ID NO: 59 - protein, 323 aa, synthetic construct
  REGION 1..323: note = CD155 v1 ECD
WPPPGTGDVVVQAPTQVSGFLGDSVTLPCYLQVPNMEVTHVSQLTWARHGESGSMAVFHQTQGSSYSESKRLEFVAARLGAELRNASLRMSGLRVEDEGNYTCLFVTFPQGSRSVDIWLRVLAKPQNTAEVQKVQLTGEPVPMARCVSTGGRPPAQITWHSDLGGMPNTSQVPGFLSGTVTVTSLWILVPSSQVDGKNVTCKVEHESFEKPQLLTVNLTVYYPPEVSISGYDNNWYLGQNEATLTCDARSNPEPTGYNWSTTMGPLPPFAVAQGAQLLIRPVDKPINTTLICNVTNALGARQAELTVQVKEGPPSEHSGISRN

SEQ ID NO: 60 - protein, 323 aa, synthetic construct
  REGION 1..323: note = CD155 v2 ECD
WPPPGTGDVVVQAPTQVSGFLGDSVTLPCYLQVPNMEVTHVSQLTWARHGESGSMAVFHQTQGPSYSESKRLEFVAARLGAELRNASLRMSGLRVEDEGNYTCPFVTFPQGSRSVDIWLRVLAKPQNTAEVQKVQLTGEPVPMARCVSTGGRPPAQITWHSDLGGMPNTSQVPGFLSGTVTVTSLWILVPSSQVDGKNVTCKVEHESFEKPQLLTVNLTVYYPPEVSISGYDNNWYLGQNEATLTCDARSNPEPTGYNWSTTMGPLPPFAVAQGAQLLIRPVDKPINTTLICNVTNALGARQAELTVQVKEGPPSEHSGISRN

SEQ ID NO: 61 - protein, 323 aa, synthetic construct
  REGION 1..323: note = CD155 v3 ECD
WPPPGTGDVVVQAPTQVPGFLGDSVTLPCYLQVPNMEVTHVSQPTWARHGESGSMAVFHQTQGPSYSESKRLEFVAARLGAELRNASLRMFGLRVEDEGNYTCLFVTFPQGSRSVDIWLRVLAKPQNTAEVQKVQLTGEPVPMARCVSTGGRPPAQITWHSDLGGMPNTSQVPGFLSGTVTVTSLWILVPSSQVDGKNVTCKVEHESFEKPQLLTVNLTVYYPPEVSISGYDNNWYLGQNEATLTCDARSNPEPTGYNWSTTMGPLPPFAVAQGAQLLIRPVDKPINTTLICNVTNALGARQAELTVQVKEGPPSEHSGISRN

SEQ ID NO: 62 - protein, 323 aa, synthetic construct
  REGION 1..323: note = CD155 v4 ECD
WPPPGTGDVVVQAPTQVPGFLGDSVTLPCYLQVPNMEVTHVSQLTWARHGESGSMVVFHQTQGPSYSESKRLEFVAARLGAELRNASLRMFGLRVEDEGNYTCLFVTFPQGSRSVDIWLRVLAKPQNTAEVQKVQLTGEPVPMARCVSTGGRPPAQITWHSDLGGMPNTSQVPGFLSGTVTVTSLWILVPSSQVDGKNVTCKVEHESFEKPQLLTVNLTVYYPPEVSISGYDNNWYLGQNEATLTCDARSNPEPTGYNWSTTMGPLPPFAVAQGAQLLIRPVDKPINTTLICNVTNALGARQAELTVQVKEGPPSEHSGISRN

SEQ ID NO: 63 - protein, 323 aa, synthetic construct
  REGION 1..323: note = CD155 v5 ECD
WPPPGTGDVVVQAPTQVLGFLGDSVTLPCYLQVPNMEVTHVSQLTWARHGESGSMAVFHQTQGPSYSESKRLEFVAARVGAELRNASLRMSGLRVEDEGNYTCLFVTFPQGSRSVDIWLRVLAKPQNTAEVQKVQLTGEPVPMARCVSTGGRPPAQITWHSDLGGMPNTSQVPGFLSGTVTVTSLWILVPSSQVDGKNVTCKVEHESFEKPQLLTVNLTVYYPPEVSISGYDNNWYLGQNEATLTCDARSNPEPTGYNWSTTMGPLPPFAVAQGAQLLIRPVDKPINTTLICNVTNALGARQAELTVQVKEGPPSEHSGISRN

SEQ ID NO: 64 - protein, 323 aa, synthetic construct
  REGION 1..323: note = CD155 v6 ECD
WPPPGTGDVVVQAPTQVSGFLGDSVTLPCYLQVPNMEVTHVSQLTWARHGESGSMAVFHQTQGPSYSESKRLEFVAARLGAELRNASLRMSGLRVEDEGNYTCLFVTFPQGSRSVDIWLRVLAKPQNTAEVQKVQLTGEPVPMARCVSTGGRPPAQITWHSDLGGMPNTSQVPGFLSGTVTVTSLWILVPSSQVDGKNVTCKVEHESFEKPQLLTVNLTVYYPPEVSISGYDNNWYLGQNEATLTCDARSNPEPTGYNWSTTMGPLPPFAVAQGAQLLIRPVDKPINTTLICNVTNALGARQAELTVQVKEGPPSEHSGISRN

SEQ ID NO: 65 - protein, 323 aa, synthetic construct
  REGION 1..323: note = CD155 v7 ECD
WPPPGTGDVVVQAPTQVTGFLGDSVTLPCYLQVPNMEVTHVSQLTWARHGESGSMAVFHQTQGPSYSESKRLEFVAARLGAELRNASLRMSGLRVEDEGNYTCLFVTFPQGSRSVDIWLRVLAKPQNTAEVQKVQLTGEPVPMARCVSTGGRPPAQITWHSDLGGMPNTSQVPGFLSGTVTVTSLWILVPSSQVDGKNVTCKVEHESFEKPQLLTVNLTVYYPPEVSISGYDNNWYLGQNEATLTCDARSNPEPTGYNWSTTMGPLPPFAVAQGAQLLIRPVDKPINTTLICNVTNALGARQAELTVQVKEGPPSEHSGISRN

SEQ ID NO: 66 - protein, 323 aa, synthetic construct
  REGION 1..323: note = CD155 v8 ECD
WPPPGTGDVVVQAPTQVTGFLGDSVTLPCYLQVPNMEVTHVPQLTWARHGESGSMAVFHQTQGPSYSESKRLEFVAARLGAELRNASLRMSGLRVEDEGNYTCLFVTFPQGSRSVDIWLRVLAKPQNTAEVQKVQLTGEPVPMARCVSTGGRPPAQITWHSDLGGMPNTSQVPGFLSGTVTVTSLWILVPSSQVDGKNVTCKVEHESFEKPQLLTVNLTVYYPPEVSISGYDNNWYLGQNEATLTCDARSNPEPTGYNWSTTMGPLPPFAVAQGAQLLIRPVDKPINTTLICNVTNALGARQAELTVQVKEGPPSEHSGISRN

SEQ ID NO: 67 - protein, 323 aa, synthetic construct
  REGION 1..323: note = CD155 v9 ECD
WPPPGTEDVVVQAPTQVTGFLGDSVTLPCCLQVPNMEVTHVSQLTWARHGESGSMAVFHQTQGPSYSESKRLEFVAARLGAELRNASLRMSGLRVEDEGNYTCLFVTFPQGSRSVDIWLRVLAKPQNTAEVQKVQLTGEPVPMARCVSTGGRPPAQITWHSDLGGMPNTSQVPGFLSGTVTVTSLWILVPSSQVDGKNVTCKVEHESFEKPQLLTVNLTVYYPPEVSISGYDNNWYLGQNEATLTCDARSNPEPTGYNWSTTMGPLPPFAVAQGAQLLIRPVDKPINTTLICNVTNALGARQAELTVQVKEGPPSEHSGISRN

SEQ ID NO: 68 - protein, 323 aa, synthetic construct
  REGION 1..323: note = CD155 v10 ECD
WPPPGTGDVVVQAPTQVTGFLGDSVTLPCYLQVPNMEVTHVSQLTWARHGESGSMAVFHQTQGPSYSESKRLEFVAARLGAELRNASLRMSGLRVEDEGNYTCLFVTFPQDSRSVDIWLRVLAKPQNTAEVQKVQLTGEPVPMARCVSTGGRPPAQITWHSDLGGMPNTSQVPGFLSGTVTVTSLWILVPSSQVDGKNVTCKVEHESFEKPQLLTVNLTVYYPPEVSISGYDNNWYLGQNEATLTCDARSNPEPTGYNWSTTMGPLPPFAVAQGAQLLIRPVDKPINTTLICNVTNALGARQAELTVQVKEGPPSEHSGISRN

SEQ ID NO: 69 - protein, 323 aa, synthetic construct
  REGION 1..323: note = CD155 v11 ECD
WPPPGTGDVVVQAPTQVSGFLGDSVTLPCYLQVPNMEVTHVSQLTWARHGESGSMAVFHQTQGPSYSESKRLEFVAARLGAELRNASLRMPGLRVEDEGNYTCLFVTFPQGSRSVDIWLRVLAKPQNTAEVQKVQLTGEPVPMARCVSTGGRPPAQITWHSDLGGMPNTSQVPGFLSGTVTVTSLWILVPSSQVDGKNVTCKVEHESFEKPQLLTVNLTVYYPPEVSISGYDNNWYLGQNEATLTCDARSNPEPTGYNWSTTMGPLPPFAVAQGAQLLIRPVDKPINTTLICNVTNALGARQAELTVQVKEGPPSEHSGISRN

SEQ ID NO: 70 - protein, 323 aa, synthetic construct
  REGION 1..323: note = CD155 v12 ECD
WPPPGTGDVVVQAPTQVTGFLGDSVTLPCYLQVPNMEVTHVSQLTWARHGESGSMAVFHQTQGPSYSESKRLEFVAARLGAELRNASLRMSGLRVEDEGNYTCLFVTLPQGSRSVDIWLRVLAKPQNTAEVQKVQLTGEPVPMARCVSTGGRPPAQITWHSDLGGMPNTSQVPGFLSGTVTVTSLWILVPSSQVDGKNVTCKVEHESFEKPQLLTVNLTVYYPPEVSISGYDNNWYLGQNEATLTCDARSNPEPTGYNWSTTMGPLPPFAVAQGAQLLIRPVDKPINTTLICNVTNALGARQAELTVQVKEGPPSEHSGISRN

SEQ ID NO: 71 - protein, 323 aa, synthetic construct; identical to SEQ ID NO: 64
  REGION 1..323: note = CD155 v13 ECD

SEQ ID NO: 72 - protein, 323 aa, synthetic construct
  REGION 1..323: note = CD155 v14 ECD
WPPPGTGDVVVQAPTQVTGFLGDSVTLPCYLQVPNMEVTHVSQLAWARHGESGSMAVFHQTQGPSYSESKRLEFVAARLGAELRNASLRMSGLRVEDEGNYTCLFVTFPQGSRSVDIWLRVLAKPQNTAEVQKVQLTGEPVPMARCVSTGGRPPAQITWHSDLGGMPNTSQVPGFLSGTVTVTSLWILVPSSQVDGKNVTCKVEHESFEKPQLLTVNLTVYYPPEVSISGYDNNWYLGQNEATLTCDARSNPEPTGYNWSTTMGPLPPFAVAQGAQLLIRPVDKPINTTLICNVTNALGARQAELTVQVKEGPPSEHSGISRN

SEQ ID NO: 73 - protein, 323 aa, synthetic construct
  REGION 1..323: note = CD155 v15 ECD
WPPPGTGDVVVQAPTQVTGFLGDSVTLPCYLQVPNMEVTHVSQLTWARHGESGSMAVFHQTQGPSYSESKRLEFVAARLGAELRNASLRMSGLHVEDEGNYTCLFVTFPQGSRSVDIWLRVLAKPQNTAEVQKVQLTGEPVPMARCVSTGGRPPAQITWHSDLGGMPNTSQVPGFLSGTVTVTSLWILVPSSQVDGKNVTCKVEHESFEKPQLLTVNLTVYYPPEVSISGYDNNWYLGQNEATLTCDARSNPEPTGYNWSTTMGPLPPFAVAQGAQLLIRPVDKPINTTLICNVTNALGARQAELTVQVKEGPPSEHSGISRN

SEQ ID NO: 74 - protein, 323 aa, synthetic construct
  REGION 1..323: note = CD155 v16 ECD
WPPPGTGDVVVQAPTQVSGFLGDSVTLPCCLQVPNMEVTHVSQLTWARHGESGSMAVFHQTQGPSYSESKRLEFVAARLGAELRNASLRMSGLRVEDEGNYTCLFVTFPQGSRSVDIWLRVLAKPQNTAEVQKVQLTGEPVPMARCVSTGGRPPAQITWHSDLGGMPNTSQVPGFLSGTVTVTSLWILVPSSQVDGKNVTCKVEHESFEKPQLLTVNLTVYYPPEVSISGYDNNWYLGQNEATLTCDARSNPEPTGYNWSTTMGPLPPFAVAQGAQLLIRPVDKPINTTLICNVTNALGARQAELTVQVKEGPPSEHSGISRN

SEQ ID NO: 75 - protein, 323 aa, synthetic construct
  REGION 1..323: note = CD155 v17 ECD
WPPPGTGDVVVQAPTQVPGFLGDSVTLPCYLQVPNMEVTHVSQLTWARHGESGSMAVFHQTQGPSYSESKRLEFVAARLGVEPRNASLRMFGLRVEDEGNYTCLFVTFPQGSRSVDIWLRVLAKPQNTAEVQKVQLTGEPVPMARCVSTGGRPPAQITWHSDLGGMPNTSQVPGFLSGTVTVTSLWILVPSSQVDGKNVTCKVEHESFEKPQLLTVNLTVYYPPEVSISGYDNNWYLGQNEATLTCDARSNPEPTGYNWSTTMGPLPPFAVAQGAQLLIRPVDKPINTTLICNVTNALGARQAELTVQVKEGPPSEHSGISRN

SEQ ID NO: 76 - protein, 323 aa, synthetic construct
  REGION 1..323: note = CD155 v18 ECD
WPPPGTGDVVVQAPTQVPGFLGDSVTLPCYLQVPNMEVTHVSQLTWARHGESGSMAVFHQTQGPSYSESKRLEFVAARLGAELRNASPRMFGLRVEDEGNYTCLFVTFPQGSRSVDIWLRVLAKPQNTAEVQKVQLTGEPVPMARCVSTGGRPPAQITWHSDLGGMPNTSQVPGFLSGTVTVTSLWILVPSSQVDGKNVTCKVEHESFEKPQLLTVNLTVYYPPEVSISGYDNNWYLGQNEATLTCDARSNPEPTGYNWSTTMGPLPPFAVAQGAQLLIRPVDKPINTTLICNVTNALGARQAELTVQVKEGPPSEHSGISRN

SEQ ID NO: 77 - protein, 323 aa, synthetic construct
  REGION 1..323: note = CD155 v19 ECD
WPPPGTGDVVVQAPTQVPGFLGDSVTLPCYLQVPNMEVTHVSQLTWARHGESGSMAVFHQTQGPSYSESKRLEFVAARLGAELRNASLRMFGLHVEDEGNYTCLFVTFPQGSRSVDIWLRVLAKPQNTAEVQKVQLTGEPVPMARCVSTGGRPPAQITWHSDLGGMPNTSQVPGFLSGTVTVTSLWILVPSSQVDGKNVTCKVEHESFEKPQLLTVNLTVYYPPEVSISGYDNNWYLGQNEATLTCDARSNPEPTGYNWSTTMGPLPPFAVAQGAQLLIRPVDKPINTTLICNVTNALGARQAELTVQVKEGPPSEHSGISRN

SEQ ID NO: 78 - protein, 323 aa, synthetic construct
  REGION 1..323: note = CD155 v20 ECD
WPPPGTGDVVVQEPTQVSGFLGDSVTLPCYLQVPNMEVTHVSQLTWARHGESGSMVVFHQTQGPSYSESKRLEFVAARLGAELRNASLRMSGLRVEDEGNYTCLFVTFPQGSRSVDIWLRVLAKPQNTAEVQKVQLTGEPVPMARCVSTGGRPPAQITWHSDLGGMPNTSQVPGFLSGTVTVTSLWILVPSSQVDGKNVTCKVEHESFEKPQLLTVNLTVYYPPEVSISGYDNNWYLGQNEATLTCDARSNPEPTGYNWSTTMGPLPPFAVAQGAQLLIRPVDKPINTTLICNVTNALGARQAELTVQVKEGPPSEHSGISRN

SEQ ID NO: 79 - protein, 323 aa, synthetic construct
  REGION 1..323: note = CD155 v21 ECD
WPPPGTGDVVVQAPTQVTGFLGDSVTLPCYLQVPNMEVTHVSQLTWARHGESGSMAVFHQTQGPSYSESKRLEFVAARLGAELRNASLRMSGLRVEDEGNYTCLFVTFPQGSRSADIWLRVLAKPQNTAEVQKVQLTGEPVPMARCVSTGGRPPAQITWHSDLGGMPNTSQVPGFLSGTVTVTSLWILVPSSQVDGKNVTCKVEHESFEKPQLLTVNLTVYYPPEVSISGYDNNWYLGQNEATLTCDARSNPEPTGYNWSTTMGPLPPFAVAQGAQLLIRPVDKPINTTLICNVTNALGARQAELTVQVKEGPPSEHSGISRN

SEQ ID NO: 80 - protein, 323 aa, synthetic construct
  REGION 1..323: note = CD155 v22 ECD
WPPPGTGDVVVQAPTQVTGFLGDSVTLPCYLQVPNMEVTHVSQLTWARHGESGSMAVFHKTQGPSYSESKRLEFVAARLGAELRNASLRMFGLRVEDEGNYTCLFVTFPQGSRSVDIWLRVLAKPQNTAEVQKVQLTGEPVPMARCVSTGGRPPAQITWHSDLGGMPNTSQVPGFLSGTVTVTSLWILVPSSQVDGKNVTCKVEHESFEKPQLLTVNLTVYYPPEVSISGYDNNWYLGQNEATLTCDARSNPEPTGYNWSTTMGPLPPFAVAQGAQLLIRPVDKPINTTLICNVTNALGARQAELTVQVKEGPPSEHSGISRN

SEQ ID NO: 81 - protein, 116 aa, synthetic construct
  REGION 1..116: note = CD155 v1 IgV
PGTGDVVVQAPTQVSGFLGDSVTLPCYLQVPNMEVTHVSQLTWARHGESGSMAVFHQTQGSSYSESKRLEFVAARLGAELRNASLRMSGLRVEDEGNYTCLFVTFPQGSRSVDIWL

SEQ ID NO: 82 - protein, 116 aa, synthetic construct
  REGION 1..116: note = CD155 v2 IgV
PGTGDVVVQAPTQVSGFLGDSVTLPCYLQVPNMEVTHVSQLTWARHGESGSMAVFHQTQGPSYSESKRLEFVAARLGAELRNASLRMSGLRVEDEGNYTCPFVTFPQGSRSVDIWL

SEQ ID NO: 83 - protein, 116 aa, synthetic construct
  REGION 1..116: note = CD155 v3 IgV
PGTGDVVVQAPTQVPGFLGDSVTLPCYLQVPNMEVTHVSQPTWARHGESGSMAVFHQTQGPSYSESKRLEFVAARLGAELRNASLRMFGLRVEDEGNYTCLFVTFPQGSRSVDIWL

SEQ ID NO: 84 - protein, 116 aa, synthetic construct
  REGION 1..116: note = CD155 v4 IgV
PGTGDVVVQAPTQVPGFLGDSVTLPCYLQVPNMEVTHVSQLTWARHGESGSMVVFHQTQGPSYSESKRLEFVAARLGAELRNASLRMFGLRVEDEGNYTCLFVTFPQGSRSVDIWL

SEQ ID NO: 85 - protein, 116 aa, synthetic construct
  REGION 1..116: note = CD155 v5 IgV
PGTGDVVVQAPTQVLGFLGDSVTLPCYLQVPNMEVTHVSQLTWARHGESGSMAVFHQTQGPSYSESKRLEFVAARVGAELRNASLRMSGLRVEDEGNYTCLFVTFPQGSRSVDIWL

SEQ ID NO: 86 - protein, 116 aa, synthetic construct
  REGION 1..116: note = CD155 v6 IgV
PGTGDVVVQAPTQVSGFLGDSVTLPCYLQVPNMEVTHVSQLTWARHGESGSMAVFHQTQGPSYSESKRLEFVAARLGAELRNASLRMSGLRVEDEGNYTCLFVTFPQGSRSVDIWL

SEQ ID NO: 87 - protein, 116 aa, synthetic construct
  REGION 1..116: note = CD155 v7 IgV
PGTGDVVVQAPTQVTGFLGDSVTLPCYLQVPNMEVTHVSQLTWARHGESGSMAVFHQTQGPSYSESKRLEFVAARLGAELRNASLRMSGLRVEDEGNYTCLFVTFPQGSRSVDIWL

SEQ ID NO: 88 - protein, 116 aa, synthetic construct
  REGION 1..116: note = CD155 v8 IgV
PGTGDVVVQAPTQVTGFLGDSVTLPCYLQVPNMEVTHVPQLTWARHGESGSMAVFHQTQGPSYSESKRLEFVAARLGAELRNASLRMSGLRVEDEGNYTCLFVTFPQGSRSVDIWL

SEQ ID NO: 89 - protein, 116 aa, synthetic construct
  REGION 1..116: note = CD155 v9 IgV
PGTEDVVVQAPTQVTGFLGDSVTLPCCLQVPNMEVTHVSQLTWARHGESGSMAVFHQTQGPSYSESKRLEFVAARLGAELRNASLRMSGLRVEDEGNYTCLFVTFPQGSRSVDIWL

SEQ ID NO: 90 - protein, 116 aa, synthetic construct
  REGION 1..116: note = CD155 v10 IgV
PGTGDVVVQAPTQVTGFLGDSVTLPCYLQVPNMEVTHVSQLTWARHGESGSMAVFHQTQGPSYSESKRLEFVAARLGAELRNASLRMSGLRVEDEGNYTCLFVTFPQDSRSVDIWL

SEQ ID NO: 91 - protein, 116 aa, synthetic construct
  REGION 1..116: note = CD155 v11 IgV
PGTGDVVVQAPTQVSGFLGDSVTLPCYLQVPNMEVTHVSQLTWARHGESGSMAVFHQTQGPSYSESKRLEFVAARLGAELRNASLRMPGLRVEDEGNYTCLFVTFPQGSRSVDIWL

SEQ ID NO: 92 - protein, 116 aa, synthetic construct
  REGION 1..116: note = CD155 v12 IgV
PGTGDVVVQAPTQVTGFLGDSVTLPCYLQVPNMEVTHVSQLTWARHGESGSMAVFHQTQGPSYSESKRLEFVAARLGAELRNASLRMSGLRVEDEGNYTCLFVTLPQGSRSVDIWL

SEQ ID NO: 93 - protein, 116 aa, synthetic construct; identical to SEQ ID NO: 86
  REGION 1..116: note = CD155 v13 IgV

SEQ ID NO: 94 - protein, 116 aa, synthetic construct
  REGION 1..116: note = CD155 v14 IgV
PGTGDVVVQAPTQVTGFLGDSVTLPCYLQVPNMEVTHVSQLAWARHGESGSMAVFHQTQGPSYSESKRLEFVAARLGAELRNASLRMSGLRVEDEGNYTCLFVTFPQGSRSVDIWL

SEQ ID NO: 95 - protein, 116 aa, synthetic construct
  REGION 1..116: note = CD155 v15 IgV
PGTGDVVVQAPTQVTGFLGDSVTLPCYLQVPNMEVTHVSQLTWARHGESGSMAVFHQTQGPSYSESKRLEFVAARLGAELRNASLRMSGLHVEDEGNYTCLFVTFPQGSRSVDIWL

SEQ ID NO: 96 - protein, 116 aa, synthetic construct
  REGION 1..116: note = CD155 v16 IgV
PGTGDVVVQAPTQVSGFLGDSVTLPCCLQVPNMEVTHVSQLTWARHGESGSMAVFHQTQGPSYSESKRLEFVAARLGAELRNASLRMSGLRVEDEGNYTCLFVTFPQGSRSVDIWL

SEQ ID NO: 97 - protein, 116 aa, synthetic construct
  REGION 1..116: note = CD155 v17 IgV
PGTGDVVVQAPTQVPGFLGDSVTLPCYLQVPNMEVTHVSQLTWARHGESGSMAVFHQTQGPSYSESKRLEFVAARLGVEPRNASLRMFGLRVEDEGNYTCLFVTFPQGSRSVDIWL

SEQ ID NO: 98 - protein, 116 aa, synthetic construct
  REGION 1..116: note = CD155 v18 IgV
PGTGDVVVQAPTQVPGFLGDSVTLPCYLQVPNMEVTHVSQLTWARHGESGSMAVFHQTQGPSYSESKRLEFVAARLGAELRNASPRMFGLRVEDEGNYTCLFVTFPQGSRSVDIWL

SEQ ID NO: 99 - protein, 116 aa, synthetic construct
  REGION 1..116: note = CD155 v19 IgV
PGTGDVVVQAPTQVPGFLGDSVTLPCYLQVPNMEVTHVSQLTWARHGESGSMAVFHQTQGPSYSESKRLEFVAARLGAELRNASLRMFGLHVEDEGNYTCLFVTFPQGSRSVDIWL

SEQ ID NO: 100 - protein, 116 aa, synthetic construct
  REGION 1..116: note = CD155 v20 IgV
PGTGDVVVQEPTQVSGFLGDSVTLPCYLQVPNMEVTHVSQLTWARHGESGSMVVFHQTQGPSYSESKRLEFVAARLGAELRNASLRMSGLRVEDEGNYTCLFVTFPQGSRSVDIWL

SEQ ID NO: 101 - protein, 116 aa, synthetic construct
  REGION 1..116: note = CD155 v21 IgV
PGTGDVVVQAPTQVTGFLGDSVTLPCYLQVPNMEVTHVSQLTWARHGESGSMAVFHQTQGPSYSESKRLEFVAARLGAELRNASLRMSGLRVEDEGNYTCLFVTFPQGSRSADIWL

SEQ ID NO: 102 - protein, 116 aa, synthetic construct
  REGION 1..116: note = CD155 v22 IgV
PGTGDVVVQAPTQVTGFLGDSVTLPCYLQVPNMEVTHVSQLTWARHGESGSMAVFHKTQGPSYSESKRLEFVAARLGAELRNASLRMFGLRVEDEGNYTCLFVTFPQGSRSVDIWL

SEQ ID NO: 103 - protein, 254 aa, Homo sapiens
  REGION 1..254: note = MISC_FEATURE - Mature CD80(B7-1)
VIHVTKEVKEVATLSCGHNVSVEELAQTRIYWQKEKKMVLTMMSGDMNIWPEYKNRTIFDITNNLSIVILALRPSDEGTYECVVLKYEKDAFKREHLAEVTLSVKADFPTPSISDFEIPTSNIRRIICSTSGGFPEPHLSWLENGEELNAINTTVSQDPETELYAVSSKLDFNMTTNHSFMCLIKYGHLRVNQTFNWNTTKQEHFPDNLLPSWAITLISVNGIFVICCLTYCFAPRCRERRRNERLRRESVRPV

SEQ ID NO: 104 - protein, 306 aa, Homo sapiens
  REGION 1..306: note = MISC_FEATURE - Mature CD86(B7-2)
APLKIQAYFNETADLPCQFANSQNQSLSELVVFWQDQENLVLNEVYLGKEKFDSVHSKYMGRTSFDSDSWTLRLHNLQIKDKGLYQCIIHHKKPTGMIRIHQMNSELSVLANFSQPEIVPISNITENVYINLTCSSIHGYPEPKKMSVLLRTKNSTIEYDGVMQKSQDNVTELYDVSISLSVSFPDVTSNMTIFCILETDKTRLLSSPFSIELEDPQPPPDHIPWITAVLPTVIICVMVFCLILWKWKKKKRPRNSYKCGTNTMEREESEQTKKREKIHIPERSDEAQRVFKSSKTSSCDKSDTCF

SEQ ID NO: 105 - protein, 272 aa, Homo sapiens
  REGION 1..272: note = MISC_FEATURE - Mature CD274 (PD-L1, B7-H1)
FTVTVPKDLYVVEYGSNMTIECKFPVEKQLDLAALIVYWEMEDKNIIQFVHGEEDLKVQHSSYRQRARLLKDQLSLGNAALQITDVKLQDAGVYRCMISYGGADYKRITVKVNAPYNKINQRILVVDPVTSEHELTCQAEGYPKAEVIWTSSDHQVLSGKTTTTNSKREEKLFNVTSTLRINTTTNEIFYCTFRRLDPEENHTAELVIPELPLAHPPNERTHLVILGAILLCLGVALTFIFRLRKGRMMDVKKCGIQDTNSKKQSDTHLEET

SEQ ID NO: 106 - protein, 254 aa, Homo sapiens
  REGION 1..254: note = MISC_FEATURE - Mature PDCD1LG2(PD-L2, CD273)
LFTVTVPKELYIIEHGSNVTLECNFDTGSHVNLGAITASLQKVENDTSPHRERATLLEEQLPLGKASFHIPQVQVRDEGQYQCIIIYGVAWDYKYLTLKVKASYRKINTHILKVPETDEVELTCQATGYPLAEVSWPNVSVPANTSHSRTPEGLYQVTSVLRLKPPPGRNFSCVFWNTHVRELTLASIDLQSQMEPRTHPTWLLHIFIPFCIIAFIFIATVIALRKQLCQKLYSSKDTTKRPVTTTKREVNSAI

SEQ ID NO: 107 - protein, 284 aa, Homo sapiens
  REGION 1..284: note = MISC_FEATURE - Mature ICOSLG(B7RP1, CD275, ICOSL, B7-H2)
DTQEKEVRAMVGSDVELSCACPEGSRFDLNDVYVYWQTSESKTVVTYHIPQNSSLENVDSRYRNRALMSPAGMLRGDFSLRLFNVTPQDEQKFHCLVLSQSLGFQEVLSVEVTLHVAANFSVPVVSAPHSPSQDELTFTCTSINGYPRPNVYWINKTDNSLLDQALQNDTVFLNMRGLYDVVSVLRIARTPSVNIGCCIENVLLQQNLTVGSQTGNDIGERDKITENPVSTGEKNAATWSILAVLCLLVVVAVAIGWVCRDRCLQHSYAGAWAVSPETELTGHV

SEQ ID NO: 108 - protein, 506 aa, Homo sapiens
  REGION 1..506: note = MISC_FEATURE - Mature CD276(B7-H3)
LEVQVPEDPVVALVGTDATLCCSFSPEPGFSLAQLNLIWQLTDTKQLVHSFAEGQDQGSAYANRTALFPDLLAQGNASLRLQRVRVADEGSFTCFVSIRDFGSAAVSLQVAAPYSKPSMTLEPNKDLRPGDTVTITCSSYQGYPEAEVFWQDGQGVPLTGNVTTSQMANEQGLFDVHSILRVVLGANGTYSCLVRNPVLQQDAHSSVTITPQRSPTGAVEVQVPEDPVVALVGTDATLRCSFSPEPGFSLAQLNLIWQLTDTKQLVHSFTEGRDQGSAYANRTALFPDLLAQGNASLRLQRVRVADEGSFTCFVSIRDFGSAAVSLQVAAPYSKPSMTLEPNKDLRPGDTVTITCSSYRGYPEAEVFWQDGQGVPLTGNVTTSQMANEQGLFDVHSVLRVVLGANGTYSCLVRNPVLQQDAHGSVTITGQPMTFPPEALWVTVGLSVCLIALLVALAFVCWRKIKQSCEEENAGAEDQDGEGEGSKTALQPLKHSDSKEDDGQEIA

SEQ ID NO: 109 - protein, 258 aa, Homo sapiens
  REGION 1..258: note = MISC_FEATURE - Mature VTCN1(B7-H4)
LIIGFGISGRHSITVTTVASAGNIGEDGILSCTFEPDIKLSDIVIQWLKEGVLGLVHEFKEGKDELSEQDEMFRGRTAVFADQVIVGNASLRLKNVQLTDAGTYKCYIITSKGKGNANLEYKTGAFSMPEVNVDYNASSETLRCEAPRWFPQPTVVWASQVDQGANFSEVSNTSFELNSENVTMKVVSVLYNVTINNTYSCMIENDIAKATGDIKVTESEIKRRSHLQLLNSKASLCVSSFFAISWALLPLSPYLMLK

SEQ ID NO: 110 - protein, 202 aa, Homo sapiens
  REGION 1..202: note = MISC_FEATURE - Mature CD28
NKILVKQSPMLVAYDNAVNLSCKYSYNLFSREFRASLHKGLDSAVEVCVVYGNYSQQLQVYSKTGFNCDGKLGNESVTFYLQNLYVNQTDIYFCKIEVMYPPPYLDNEKSNGTIIHVKGKHLCPSPLFPGPSKPFWVLVVVGGVLACYSLLVTVAFIIFWVRSKRSRLLHSDYMNMTPRRPGPTRKHYQPYAPPRDFAAYRS

SEQ ID NO: 111 - protein, 188 aa, Homo sapiens
  REGION 1..188: note = MISC_FEATURE - Mature CTLA4
KAMHVAQPAVVLASSRGIASFVCEYASPGKATEVRVTVLRQADSQVTEVCAATYMMGNELTFLDDSICTGTSSGNQVNLTIQGLRAMDTGLYICKVELMYPPPYYLGIGNGTQIYVIDPEPCPDSDFLLWILAAVSSGLFFYSFLLTAVSLSKMLKKRSPLTTGVYVKMPPTEPECEKQFQPYFIPIN

SEQ ID NO: 112 - protein, 268 aa, Homo sapiens
  REGION 1..268: note = MISC_FEATURE - Mature PDCD1(PD-1)
PGWFLDSPDRPWNPPTFSPALLVVTEGDNATFTCSFSNTSESFVLNWYRMSPSNQTDKLAAFPEDRSQPGQDCRFRVTQLPNGRDFHMSVVRARRNDSGTYLCGAISLAPKAQIKESLRAELRVTERRAEVPTAHPSPSPRPAGQFQTLVVGVVGGLLGSLVLLVWVLAVICSRAARGTIGARRTGQPLKEDPSAVPVFSVDYGELDFQWREKTPEPPVPCVPEQTEYATIVFPSGMGTSSPARRGSADGPRSAQPLRPEDGHCSWPL

SEQ ID NO: 113 - protein, 179 aa, Homo sapiens
  REGION 1..179: note = MISC_FEATURE - Mature ICOS
EINGSANYEMFIFHNGGVQILCKYPDIVQQFKMQLLKGGQILCDLTKTKGSGNTVSIKSLKFCHSQLSNNSVSFFLYNLDHSHANYYFCNLSIFDPPPFKVTLTGGYLHIYESQLCCQLKFWLPIGCAAFVVVCILGCILICWLTKKKYSSSVHDPNGEYMFMRAVNTAKKSRLTDVTL

SEQ ID NO: 114 - protein, 259 aa, Homo sapiens
  REGION 1..259: note = MISC_FEATURE - Mature BTLA(CD272)
KESCDVQLYIKRQSEHSILAGDPFELECPVKYCANRPHVTWCKLNGTTCVKLEDRQTSWKEEKNISFFILHFEPVLPNDNGSYRCSANFQSNLIESHSTTLYVTDVKSASERPSKDEMASRPWLLYRLLPLGGLPLLITTCFCLFCCLRRHQGKQNELSDTAGREINLVDAHLKSEQTEASTRQNSQVLLSETGIYDNDPDLCFRMQEGSEVYSNPCLEENKPGIVYASLNHSVIGPNSRLARNVKEAPTEYASICVRS

SEQ ID NO: 115 - protein, 433 aa, Homo sapiens
  REGION 1..433: note = MISC_FEATURE - Mature CD4
KKVVLGKKGDTVELTCTASQKKSIQFHWKNSNQIKILGNQGSFLTKGPSKLNDRADSRRSLWDQGNFPLIIKNLKIEDSDTYICEVEDQKEEVQLLVFGLTANSDTHLLQGQSLTLTLESPPGSSPSVQCRSPRGKNIQGGKTLSVSQLELQDSGTWTCTVLQNQKKVEFKIDIVVLAFQKASSIVYKKEGEQVEFSFPLAFTVEKLTGSGELWWQAERASSSKSWITFDLKNKEVSVKRVTQDPKLQMGKKLPLHLTLPQALPQYAGSGNLTLALEAKTGKLHQEVNLVVMRATQLQKNLTCEVWGPTSPKLMLSLKLENKEAKVSKREKAVWVLNPEAGMWQCLLSDSGQVLLESNIKVLPTWSTPVQPMALIVLGGVAGLLLFIGLGIFFCVRCRHRRRQAERMSQIKRLLSEKKTCQCPHRFQKTCSPI

SEQ ID NO: 116 - protein, 214 aa, Homo sapiens
  REGION 1..214: note = MISC_FEATURE - Mature CD8A(CD8-alpha)
SQFRVSPLDRTWNLGETVELKCQVLLSNPTSGCSWLFQPRGAAASPTFLLYLSQNKPKAAEGLDTQRFSGKRLGDTFVLTLSDFRRENEGYYFCSALSNSIMYFSHFVPVFLPAKPTTTPAPRPPTPAPTIASQPLSLRPEACRPAAGGAVHTRGLDFACDIYIWAPLAGTCGVLLLSLVITLYCNHRNRRRVCKCPRPVVKSGDKPSLSARYV

SEQ ID NO: 117 - protein, 189 aa, Homo sapiens
  REGION 1..189: note = MISC_FEATURE - Mature CD8B(CD8-beta)
LQQTPAYIKVQTNKMVMLSCEAKISLSNMRIYWLRQRQAPSSDSHHEFLALWDSAKGTIHGEEVEQEKIAVFRDASRFILNLTSVKPEDSGIYFCMIVGSPELTFGKGTQLSVVDFLPTTAQPTKKSTLKKRVCRLPRPETQKGPLCSPITLGLLVAGVLVLLVSLGVAIHLCCRRRRARLRFMKQFYK

SEQ ID NO: 118 - protein, 497 aa, Homo sapiens
  REGION 1..497: note = MISC_FEATURE - Mature LAG3
VPVVWAQEGAPAQLPCSPTIPLQDLSLLRRAGVTWQHQPDSGPPAAAPGHPLAPGPHPAAPSSWGPRPRRYTVLSVGPGGLRSGRLPLQPRVQLDERGRQRGDFSLWLRPARRADAGEYRAAVHLRDRALSCRLRLRLGQASMTASPPGSLRASDWVILNCSFSRPDRPASVHWFRNRGQGRVPVRESPHHHLAESFLFLPQVSPMDSGPWGCILTYRDGFNVSIMYNLTVLGLEPPTPLTVYAGAGSRVGLPCRLPAGVGTRSFLTAKWTPPGGGPDLLVTGDNGDFTLRLEDVSQAQAGTYTCHIHLQEQQLNATVTLAIITVTPKSFGSPGSLGKLLCEVTPVSGQERFVWSSLDTPSQRSFSGPWLEAQEAQLLSQPWQCQLYQGERLLGAAVYFTELSSPGAQRSGRAPGALPAGHLLLFLILGVLSLLLLVTGAFGFHLWRRQWRPRRFSALEQGIHPPQAQSKIEELEQEPEPEPEPEPEPEPEPEPEQL

SEQ ID NO: 119 - protein, 280 aa, Homo sapiens
  REGION 1..280: note = MISC_FEATURE - Mature HAVCR2(TIM-3)
SEVEYRAEVGQNAYLPCFYTPAAPGNLVPVCWGKGACPVFECGNVVLRTDERDVNYWTSRYWLNGDFRKGDVSLTIENVTLADSGIYCCRIQIPGIMNDEKFNLKLVIKPAKVTPAPTRQRDFTAAFPRMLTTRGHGPAETQTLGSLPDINLTQISTLANELRDSRLANDLRDSGATIRIGIYIGAGICAGLALALIFGALIFKWYSHSKEKIQNLSLISLANLPPSGLANAVAEGIRSEENIYTIEENVYEVEEPNEYYCYVSSRQQPSQPLGCRFAMP

SEQ ID NO: 120 - protein, 492 aa, Homo sapiens
  REGION 1..492: note = MISC_FEATURE - Mature CEACAM1
QLTTESMPFNVAEGKEVLLLVHNLPQQLFGYSWYKGERVDGNRQIVGYAIGTQQATPGPANSGRETIYPNASLLIQNVTQNDTGFYTLQVIKSDLVNEEATGQFHVYPELPKPSISSNNSNPVEDKDAVAFTCEPETQDTTYLWWINNQSLPVSPRLQLSNGNRTLTLLSVTRNDTGPYECEIQNPVSANRSDPVTLNVTYGPDTPTISPSDTYYRPGANLSLSCYAASNPPAQYSWLINGTFQQSTQELFIPNITVNNSGSYTCHANNSVTGCNRTTVKTIIVTELSPVVAKPQIKASKTTVTGDKDSVNLTCSTNDTGISIRWFFKNQSLPSSERMKLSQGNTTLSINPVKREDAGTYWCEVFNPISKNQSDPIMLNVNYNALPQENGLSPGAIAGIVIGVVALVALIAVALACFLHFGKTGRASDQRDLTEHKPSVSNHTQDHSNDPPNKMNEVTYSTLNFEAQQPTQPTSASPSLTATEIIYSEVKKQ

SEQ ID NO: 121 - protein, 222 aa, Homo sapiens
  REGION 1..222: note = MISC_FEATURE - Mature TIGIT
MTGTIETTGNISAEKGGSIILQCHLSSTTAQVTQVNWEQQDQLLAICNADLGWHISPSFKDRVAPGPGLGLTLQSLTVNDTGEYFCIYHTYPDGTYTGRIFLEVLESSVAEHGARFQIPLLGAMAATLVVICTAVIVVVALTRKKKALRIHSVEGDLRRKSAGQEEWSPSAPSPPGSCVQAEAAPAGLCGEQRGEDCAELHDYFNVLSYRSLGNCSFFTETG

SEQ ID NO: 122 - protein, 397 aa, Homo sapiens
  REGION 1..397: note = MISC_FEATURE - Mature PVR(CD155)
WPPPGTGDVVVQAPTQVPGFLGDSVTLPCYLQVPNMEVTHVSQLTWARHGESGSMAVFHQTQGPSYSESKRLEFVAARLGAELRNASLRMFGLRVEDEGNYTCLFVTFPQGSRSVDIWLRVLAKPQNTAEVQKVQLTGEPVPMARCVSTGGRPPAQITWHSDLGGMPNTSQVPGFLSGTVTVTSLWILVPSSQVDGKNVTCKVEHESFEKPQLLTVNLTVYYPPEVSISGYDNNWYLGQNEATLTCDARSNPEPTGYNWSTTMGPLPPFAVAQGAQLLIRPVDKPINTTLICNVTNALGARQAELTVQVKEGPPSEHSGISRNAIIFLVLGILVFLILLGIGIYFYWSKCSREVLWHCHLCPSSTEHASASANGHVSYSAVSRENSSSQDPQTEGTR

SEQ ID NO: 123 - protein, 507 aa, Homo sapiens
  REGION 1..507: note = MISC_FEATURE - Mature PVRL2(CD112)
QDVRVQVLPEVRGQLGGTVELPCHLLPPVPGLYISLVTWQRPDAPANHQNVAAFHPKMGPSFPSPKPGSERLSFVSAKQSTGQDTEAELQDATLALHGLTVEDEGNYTCEFATFPKGSVRGMTWLRVIAKPKNQAEAQKVTFSQDPTTVALCISKEGRPPARISWLSSLDWEAKETQVSGTLAGTVTVTSRFTLVPSGRADGVTVTCKVEHESFEEPALIPVTLSVRYPPEVSISGYDDNWYLGRTDATLSCDVRSNPEPTGYDWSTTSGTFPTSAVAQGSQLVIHAVDSLFNTTFVCTVTNAVGMGRAEQVIFVRETPNTAGAGATGGIIGGIIAAIIATAVAATGILICRQQRKEQTLQGAEEDEDLEGPPSYKPPTPKAKLEAQEMPSQLFTLGASEHSPLKTPYFDAGASCTEQEMPRYHELPTLEERSGPLHPGATSLGSPIPVPPGPPAVEDVSLDLEDEEGEEEEEYLDKINPIYDALSYSSPSDSYQGKGFVMSRAMYV

SEQ ID NO: 124 - protein, 318 aa, Homo sapiens
  REGION 1..318: note = MISC_FEATURE - Mature CD226
EEVLWHTSVPFAENMSLECVYPSMGILTQVEWFKIGTQQDSIAIFSPTHGMVIRKPYAERVYFLNSTMASNNMTLFFRNASEDDVGYYSCSLYTYPQGTWQKVIQVVQSDSFEAAVPSNSHIVSEPGKNVTLTCQPQMTWPVQAVRWEKIQPRQIDLLTYCNLVHGRNFTSKFPRQIVSNCSHGRWSVIVIPDVTVSDSGLYRCYLQASAGENETFVMRLTVAEGKTDNQYTLFVAGGTVLLLLFVISITTIIVIFLNRRRRRERRDLFTESWDTQKAPNNYRSPISTSQPTNQSMDDTREDIYVNYPTFSRRPKTRV

SEQ ID NO: 125 - protein, 327 aa, Homo sapiens
  REGION 1..327: note = MISC_FEATURE - Mature CD2
KEITNALETWGALGQDINLDIPSFQMSDDIDDIKWEKTSDKKKIAQFRKEKETFKEKDTYKLFKNGTLKIKHLKTDDQDIYKVSIYDTKGKNVLEKIFDLKIQERVSKPKISWTCINTTLTCEVMNGTDPELNLYQDGKHLKLSQRVITHKWTTSLSAKFKCTAGNKVSKESSVEPVSCPEKGLDIYLIIGICGGGSLLMVFVALLVFYITKRKKQRSRRNDEELETRAHRVATEERGRKPHQIPASTPQNPATSQHPPPPPGHRSQAPSHRPPPPGHRVQHQPQKRPPAPSGTQVHQQKGPPLPRPRVQPKPPHGAAENSLSPSSN

SEQ ID NO: 126 - protein, 154 aa, Homo sapiens
  REGION 1..154: note = MISC_FEATURE - Mature CD160
INITSSASQEGTRLNLICTVWHKKEEAEGFVVFLCKDRSGDCSPETSLKQLRLKRDPGIDGVGEISSQLMFTISQVTPLHSGTYQCCARSQKSGIRLQGHFFSILFTETGNYTVTGLKQRQHLEFSHNEGTLSSGFLQEKVWVMLVTSLVALQA

SEQ ID NO: 127 - protein, 248 aa, Homo sapiens
  REGION 1..248: note = MISC_FEATURE - Mature CD200
QVQVVTQDEREQLYTPASLKCSLQNAQEALIVTWQKKKAVSPENMVTFSENHGVVIQPAYKDKINITQLGLQNSTITFWNITLEDEGCYMCLFNTFGFGKISGTACLTVYVQPIVSLHYKFSEDHLNITCSATARPAPMVFWKVPRSGIENSTVTLSHPNGTTSVTSILHIKDPKNQVGKEVICQVLHLGTVTDFKQTVNKGYWFSVPLLLSIVSLVILLVLISILLYWKRHRNQDRGELSQGVQKMT

SEQ ID NO: 128 - protein, 297 aa, Homo sapiens
  REGION 1..297: note = MISC_FEATURE - Mature CD200R1(CD200R)
MDEKQITQNYSKVLAEVNTSWPVKMATNAVLCCPPIALRNLIIITWEIILRGQPSCTKAYRKETNETKETNCTDERITWVSRPDQNSDLQIRPVAITHDGYYRCIMVTPDGNFHRGYHLQVLVTPEVTLFQNRNRTAVCKAVAGKPAAQISWIPEGDCATKQEYWSNGTVTVKSTCHWEVHNVSTVTCHVSHLTGNKSLYIELLPVPGAKKSAKLYIPYIILTIIILTIVGFIWLLKVNGCRKYKLNKTESTPVVEEDEMQPYASYTEKNNPLYDTTNKVKASEALQSEVDTDLHTL

SEQ ID NO: 129 - protein, 183 aa, Homo sapiens
  REGION 1..183: note = MISC_FEATURE - Mature NC R3 (NKp30)
LWVSQPPEIRTLEGSSAFLPCSFNASQGRLAIGSVTWFRDEVVPGKEVRNGTPEFRGRLAPLASSRFLHDHQAELHIRDVRGHDASIYVCRVEVLGLGVGTGNGTRLVVEKEHPQLGAGTVLLLRAGFYAVSFLSVAVGSTVYYQGKCLTWKGPRRQLPAVVPAPLPPPCGSSAHLLPPVPGG

SEQ ID NO: 130 - protein, 71 aa, synthetic construct
  REGION 1..71: note = CD8-derived hinge and transmembrane domain
KPTTTPAPRPPTPAPTIASQPLSLRPEASRPAAGGAVHTRGLDFASDIYIWAPLAGTCGVLLLSLVITLYC

SEQ ID NO: 131 - protein, 112 aa, synthetic construct
  REGION 1..112: note = CD3zeta intracellular signaling domain
RVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 132 - protein, 414 aa, Homo sapiens
  REGION 1..414: note = MISC_FEATURE - VSIG8
MRVGGAFHLLLVCLSPALLSAVRINGDGQEVLYLAEGDNVRLGCPYVLDPEDYGPNGLDIEWMQVNSDPAHHRENVFLSYQDKRINHGSLPHLQQRVRFAASDPSQYDASINLMNLQVSDTATYECRVKKTTMATRKVIVTVQARPAVPMCWTEGHMTYGNDVVLKCYASGGSQPLSYKWAKISGHHYPYRAGSYTSQHSYHSELSYQESFHSSINQGLNNGDLVLKDISRADDGLYQCTVANNVGYSVCVVEVKVSDSRRIGVIIGIVLGSLLALGCLAVGIWGLVCCCCGGSGAGGARGAFGYGNGGGVGGGACGDLASEIREDAVAPGCKASGRGSRVTHLLGYPTQNVSRSLRRKYAPPPCGGPEDVALAPCTAAAACEAGPSPVYVKVKSAEPADCAEGPVQCKNGLLV

SEQ ID NO: 133 - protein, 393 aa, Homo sapiens
  REGION 1..393: note = MISC_FEATURE - Mature VSIG8
VRINGDGQEVLYLAEGDNVRLGCPYVLDPEDYGPNGLDIEWMQVNSDPAHHRENVFLSYQDKRINHGSLPHLQQRVRFAASDPSQYDASINLMNLQVSDTATYECRVKKTTMATRKVIVTVQARPAVPMCWTEGHMTYGNDVVLKCYASGGSQPLSYKWAKISGHHYPYRAGSYTSQHSYHSELSYQESFHSSINQGLNNGDLVLKDISRADDGLYQCTVANNVGYSVCVVEVKVSDSRRIGVIIGIVLGSLLALGCLAVGIWGLVCCCCGGSGAGGARGAFGYGNGGGVGGGACGDLASEIREDAVAPGCKASGRGSRVTHLLGYPTQNVSRSLRRKYAPPPCGGPEDVALAPCTAAAACEAGPSPVYVKVKSAEPADCAEGPVQCKNGLLV

SEQ ID NO: 134 - protein, 242 aa, Homo sapiens
  REGION 1..242: note = MISC_FEATURE - VSIG8 ECD
VRINGDGQEVLYLAEGDNVRLGCPYVLDPEDYGPNGLDIEWMQVNSDPAHHRENVFLSYQDKRINHGSLPHLQQRVRFAASDPSQYDASINLMNLQVSDTATYECRVKKTTMATRKVIVTVQARPAVPMCWTEGHMTYGNDVVLKCYASGGSQPLSYKWAKISGHHYPYRAGSYTSQHSYHSELSYQESFHSSINQGLNNGDLVLKDISRADDGLYQCTVANNVGYSVCVVEVKVSDSRRIG

SEQ ID NO: 135 - protein, 16 aa, synthetic construct
  REGION 1..16: note = CD33 Signal Peptide
MPLLLLLPLLWAGALA

SEQ ID NO: 136 - protein, 22 aa, synthetic construct
  REGION 1..22: note = IgGkappa light chain
MDMRVLAQLLGLLLLCFPGARC

SEQ ID NO: 137 - protein, 18 aa, synthetic construct
  REGION 1..18: note = HSA signal peptide
MKWVTFISLLFLFSSAYS

SEQ ID NO: 138 - protein, 22 aa, synthetic construct
  REGION 1..22: note = Ig kappa light chain
MDMRAPAGIFGFLLVLFPGYRS

SEQ ID NO: 139 - protein, 19 aa, synthetic construct
  REGION 1..19: note = Human azurocidin preprotein signal sequence
MTRLTVLALLAGLLASSRA

SEQ ID NO: 140 - protein, 19 aa, synthetic construct
  REGION 1..19: note = IgG heavy chain signal peptide
MELGLSWIFLLAILKGVQC

SEQ ID NO: 141 - protein, 19 aa, synthetic construct
  REGION 1..19: note = IgG heavy chain signal peptide
MELGLRWVFLVAILEGVQC

SEQ ID NO: 142 - protein, 19 aa, synthetic construct
  REGION 1..19: note = IgG heavy chain signal peptide
MKHLWFFLLLVAAPRWVLS

SEQ ID NO: 143 - protein, 19 aa, synthetic construct
  REGION 1..19: note = IgG heavy chain signal peptide
MDWTWRILFLVAAATGAHS

SEQ ID NO: 144 - protein, 19 aa, synthetic construct
  REGION 1..19: note = IgG heavy chain signal peptide
MDWTWRFLFVVAAATGVQS

SEQ ID NO: 145 - protein, 19 aa, synthetic construct
  REGION 1..19: note = IgG heavy chain signal peptide
MEFGLSWLFLVAILKGVQC

SEQ ID NO: 146 - protein, 19 aa, synthetic construct
  REGION 1..19: note = IgG heavy chain signal peptide
MEFGLSWVFLVALFRGVQC

SEQ ID NO: 147 - protein, 26 aa, synthetic construct
  REGION 1..26: note = IgG heavy chain signal peptide
MDLLHKNMKHLWFFLLLVAAPRWVLS

SEQ ID NO: 148 - protein, 22 aa, synthetic construct
  REGION 1..22: note = IgG Kappa light chain signal sequence
MDMRVPAQLLGLLLLWLSGARC

SEQ ID NO: 149 - protein, 22 aa, synthetic construct
  REGION 1..22: note = IgG Kappa light chain signal sequence
MKYLLPTAAAGLLLLAAQPAMA

SEQ ID NO: 150 - protein, 17 aa, synthetic construct
  REGION 1..17: note = Gaussia luciferase
MGVKVLFALICIAVAEA

SEQ ID NO: 151 - protein, 18 aa, synthetic construct
  REGION 1..18: note = Human albumin
MKWVTFISLLFLFSSAYS

SEQ ID NO: 152 - protein, 18 aa, synthetic construct
  REGION 1..18: note = Human chymotrypsinogen
MAFLWLLSCWALLGTTFG

SEQ ID NO: 153 - protein, 14 aa, synthetic construct
  REGION 1..14: note = Human interleukin-2
MQLLSCIALILALV

SEQ ID NO: 154 - protein, 15 aa, synthetic construct
  REGION 1..15: note = Human trypsinogen-2
MNLLLILTFVAAAVA

SEQ ID NO: 155 - protein, 122 aa, Homo sapiens
  REGION 1..122: note = MISC_FEATURE - CD155 IgV wildtype
WPPPGTGDVVVQAPTQVPGFLGDSVTLPCYLQVPNMEVTHVSQLTWARHGESGSMAVFHQTQGPSYSESKRLEFVAARLGAELRNASLRMFGLRVEDEGNYTCLFVTFPQGSRSVDIWLRVL

SEQ ID NO: 156 - protein, 122 aa, synthetic construct
  REGION 1..122: note = CD155 v1 IgV
WPPPGTGDVVVQAPTQVSGFLGDSVTLPCYLQVPNMEVTHVSQLTWARHGESGSMAVFHQTQGSSYSESKRLEFVAARLGAELRNASLRMSGLRVEDEGNYTCLFVTFPQGSRSVDIWLRVL

SEQ ID NO: 157 - protein, 122 aa, synthetic construct
  REGION 1..122: note = CD155 v2 IgV
WPPPGTGDVVVQAPTQVSGFLGDSVTLPCYLQVPNMEVTHVSQLTWARHGESGSMAVFHQTQGPSYSESKRLEFVAARLGAELRNASLRMSGLRVEDEGNYTCPFVTFPQGSRSVDIWLRVL

SEQ ID NO: 158 - protein, 122 aa, synthetic construct
  REGION 1..122: note = CD155 v3 IgV
WPPPGTGDVVVQAPTQVPGFLGDSVTLPCYLQVPNMEVTHVSQPTWARHGESGSMAVFHQTQGPSYSESKRLEFVAARLGAELRNASLRMFGLRVEDEGNYTCLFVTFPQGSRSVDIWLRVL

SEQ ID NO: 159 - protein, 122 aa, synthetic construct
  REGION 1..122: note = CD155 v4 IgV
WPPPGTGDVVVQAPTQVPGFLGDSVTLPCYLQVPNMEVTHVSQLTWARHGESGSMVVFHQTQGPSYSESKRLEFVAARLGAELRNASLRMFGLRVEDEGNYTCLFVTFPQGSRSVDIWLRVL

SEQ ID NO: 160 - protein, 122 aa, synthetic construct
  REGION 1..122: note = CD155 v5 IgV
WPPPGTGDVVVQAPTQVLGFLGDSVTLPCYLQVPNMEVTHVSQLTWARHGESGSMAVFHQTQGPSYSESKRLEFVAARVGAELRNASLRMSGLRVEDEGNYTCLFVTFPQGSRSVDIWLRVL

SEQ ID NO: 161 - protein, 122 aa, synthetic construct
  REGION 1..122: note = CD155 v6 IgV
WPPPGTGDVVVQAPTQVSGFLGDSVTLPCYLQVPNMEVTHVSQLTWARHGESGSMAVFHQTQGPSYSESKRLEFVAARLGAELRNASLRMSGLRVEDEGNYTCLFVTFPQGSRSVDIWLRVL

SEQ ID NO: 162 - protein, 122 aa, synthetic construct
  REGION 1..122: note = CD155 v7 IgV
WPPPGTGDVVVQAPTQVTGFLGDSVTLPCYLQVPNMEVTHVSQLTWARHGESGSMAVFHQTQGPSYSESKRLEFVAARLGAELRNASLRMSGLRVEDEGNYTCLFVTFPQGSRSVDIWLRVL

SEQ ID NO: 163 - protein, 122 aa, synthetic construct
  REGION 1..122: note = CD155 v8 IgV
WPPPGTGDVVVQAPTQVTGFLGDSVTLPCYLQVPNMEVTHVPQLTWARHGESGSMAVFHQTQGPSYSESKRLEFVAARLGAELRNASLRMSGLRVEDEGNYTCLFVTFPQGSRSVDIWLRVL

SEQ ID NO: 164 - protein, 122 aa, synthetic construct
  REGION 1..122: note = CD155 v9 IgV
WPPPGTEDVVVQAPTQVTGFLGDSVTLPCCLQVPNMEVTHVSQLTWARHGESGSMAVFHQTQGPSYSESKRLEFVAARLGAELRNASLRMSGLRVEDEGNYTCLFVTFPQGSRSVDIWLRVL

SEQ ID NO: 165 - protein, 122 aa, synthetic construct
  REGION 1..122: note = CD155 v10 IgV
WPPPGTGDVVVQAPTQVTGFLGDSVTLPCYLQVPNMEVTHVSQLTWARHGESGSMAVFHQTQGPSYSESKRLEFVAARLGAELRNASLRMSGLRVEDEGNYTCLFVTFPQDSRSVDIWLRVL

SEQ ID NO: 166 - protein, 122 aa, synthetic construct
  REGION 1..122: note = CD155 v11 IgV
WPPPGTGDVVVQAPTQVSGFLGDSVTLPCYLQVPNMEVTHVSQLTWARHGESGSMAVFHQTQGPSYSESKRLEFVAARLGAELRNASLRMPGLRVEDEGNYTCLFVTFPQGSRSVDIWLRVL

SEQ ID NO: 167 - protein, 122 aa, synthetic construct
  REGION 1..122: note = CD155 v12 IgV
WPPPGTGDVVVQAPTQVTGFLGDSVTLPCYLQVPNMEVTHVSQLTWARHGESGSMAVFHQTQGPSYSESKRLEFVAARLGAELRNASLRMSGLRVEDEGNYTCLFVTLPQGSRSVDIWLRVL

SEQ ID NO: 168 - protein, 122 aa, synthetic construct; identical to SEQ ID NO: 161
  REGION 1..122: note = CD155 v13 IgV

SEQ ID NO: 169 - protein, 122 aa, synthetic construct
  REGION 1..122: note = CD155 v14 IgV
WPPPGTGDVVVQAPTQVTGFLGDSVTLPCYLQVPNMEVTHVSQLAWARHGESGSMAVFHQTQGPSYSESKRLEFVAARLGAELRNASLRMSGLRVEDEGNYTCLFVTFPQGSRSVDIWLRVL

SEQ ID NO: 170 - protein, 122 aa, synthetic construct
  REGION 1..122: note = CD155 v15 IgV
WPPPGTGDVVVQAPTQVTGFLGDSVTLPCYLQVPNMEVTHVSQLTWARHGESGSMAVFHQTQGPSYSESKRLEFVAARLGAELRNASLRMSGLHVEDEGNYTCLFVTFPQGSRSVDIWLRVL

SEQ ID NO: 171 - protein, 122 aa, synthetic construct
  REGION 1..122: note = CD155 v16 IgV
WPPPGTGDVVVQAPTQVSGFLGDSVTLPCCLQVPNMEVTHVSQLTWARHGESGSMAVFHQTQGPSYSESKRLEFVAARLGAELRNASLRMSGLRVEDEGNYTCLFVTFPQGSRSVDIWLRVL

SEQ ID NO: 172 - protein, 122 aa, synthetic construct
  REGION 1..122: note = CD155 v17 IgV
WPPPGTGDVVVQAPTQVPGFLGDSVTLPCYLQVPNMEVTHVSQLTWARHGESGSMAVFHQTQGPSYSESKRLEFVAARLGVEPRNASLRMFGLRVEDEGNYTCLFVTFPQGSRSVDIWLRVL

SEQ ID NO: 173 - protein, 122 aa, synthetic construct
  REGION 1..122: note = CD155 v18 IgV
WPPPGTGDVVVQAPTQVPGFLGDSVTLPCYLQVPNMEVTHVSQLTWARHGESGSMAVFHQTQGPSYSESKRLEFVAARLGAELRNASPRMFGLRVEDEGNYTCLFVTFPQGSRSVDIWLRVL

SEQ ID NO: 174 - protein, 122 aa, synthetic construct
  REGION 1..122: note = CD155 v19 IgV
WPPPGTGDVVVQAPTQVPGFLGDSVTLPCYLQVPNMEVTHVSQLTWARHGESGSMAVFHQTQGPSYSESKRLEFVAARLGAELRNASLRMFGLHVEDEGNYTCLFVTFPQGSRSVDIWLRVL

SEQ ID NO: 175 - protein, 122 aa, synthetic construct
  REGION 1..122: note = CD155 v20 IgV
WPPPGTGDVVVQEPTQVSGFLGDSVTLPCYLQVPNMEVTHVSQLTWARHGESGSMVVFHQTQGPSYSESKRLEFVAARLGAELRNASLRMSGLRVEDEGNYTCLFVTFPQGSRSVDIWLRVL

SEQ ID NO: 176 - protein, 122 aa, synthetic construct
  REGION 1..122: note = CD155 v21 IgV
WPPPGTGDVVVQAPTQVTGFLGDSVTLPCYLQVPNMEVTHVSQLTWARHGESGSMAVFHQTQGPSYSESKRLEFVAARLGAELRNASLRMSGLRVEDEGNYTCLFVTFPQGSRSADIWLRVL

SEQ ID NO: 177 - protein, 122 aa, synthetic construct
  REGION 1..122: note = CD155 v22 IgV
WPPPGTGDVVVQAPTQVTGFLGDSVTLPCYLQVPNMEVTHVSQLTWARHGESGSMAVFHKTQGPSYSESKRLEFVAARLGAELRNASLRMFGLRVEDEGNYTCLFVTFPQGSRSVDIWLRVL

SEQ ID NO: 178 - protein, 323 aa, synthetic construct
  REGION 1..323: note = CD155 v23 ECD
WPPPGTGDVVVQAPTQVPGFLGDSVTLPCYLQVPNMEVTHVSQLTWARHGEMGSMAVFHQTQGPSYSESKRLEFVAARLGAELRNASLRMFGLRVEDEGNYTCLFVTFPQGSRSVDIWLRVLAKPQNTAEVQKVQLTGEPVPMARCVSTGGRPPAQITWHSDLGGMPNTSQVPGFLSGTVTVTSLWILVPSSQVDGKNVTCKVEHESFEKPQLLTVNLTVYYPPEVSISGYDNNWYLGQNEATLTCDARSNPEPTGYNWSTTMGPLPPFAVAQGAQLLIRPVDKPINTTLICNVTNALGARQAELTVQVKEGPPSEHSGISRN

SEQ ID NO: 179 - protein, 323 aa, synthetic construct
  REGION 1..323: note = CD155 v24 ECD
WPPPGTGDVVVQAPTQVPGFLGDSVTLPCYLQVPNMEVTHVSQLQWARHGELGSMAVFHQTQGPSYSESKRLEFVAARLGAELRNASLRMFGLRVEDEGNYTCEFVTFPQRSRSVDIWLRVLAKPQNTAEVQKVQLTGEPVPMARCVSTGGRPPAQITWHSDLGGMPNTSQVPGFLSGTVTVTSLWILVPSSQVDGKNVTCKVEHESFEKPQLLTVNLTVYYPPEVSISGYDNNWYLGQNEATLTCDARSNPEPTGYNWSTTMGPLPPFAVAQGAQLLIRPVDKPINTTLICNVTNALGARQAELTVQVKEGPPSEHSGISRN

SEQ ID NO: 180 - protein, 323 aa, synthetic construct
  REGION 1..323: note = CD155 v25 ECD
WPPPGTGDVVVQAPTQVPGFLGDSVTLPCYLQVPNMEVTHVGQLTWARHGESGSMAVFHQTQGPSYSESKRLEFVAARLGAELRNASLRMFGLRVEDEGNYTCLFVTFPQGSRSVDIWLRVLAKPQNTAEVQKVQLTGEPVPMARCVSTGGRPPAQITWHSDLGGMPNTSQVPGFLSGTVTVTSLWILVPSSQVDGKNVTCKVEHESFEKPQLLTVNLTVYYPPEVSISGYDNNWYLGQNEATLTCDARSNPEPTGYNWSTTMGPLPPFAVAQGAQLLIRPVDKPINTTLICNVTNALGARQAELTVQVKEGPPSEHSGISRN

SEQ ID NO: 181 - protein, 323 aa, synthetic construct
  REGION 1..323: note = CD155 v26 ECD
WPPPGTGDVVVQAPTQVPGFLGDSVTLPCYLQVPNMEVTHVSQLTWARHGESGSMAVFHQTFGPSYSESKRLEFVAARLGAELRNASLRMFGLRVEDEGNYTCLFVTFPQGSRSVDIWLRVLAKPQNTAEVQKVQLTGEPVPMARCVSTGGRPPAQITWHSDLGGMPNTSQVPGFLSGTVTVTSLWILVPSSQVDGKNVTCKVEHESFEKPQLLTVNLTVYYPPEVSISGYDNNWYLGQNEATLTCDARSNPEPTGYNWSTTMGPLPPFAVAQGAQLLIRPVDKPINTTLICNVTNALGARQAELTVQVKEGPPSEHSGISRN

SEQ ID NO: 182 - protein, 323 aa, synthetic construct
  REGION 1..323: note = CD155 v27 ECD
WPPPGTGDVVVQAPTQVPGFLGDSVTLPCYLQVPNMEVTHVSQLTWARHGEQGSMAVFHQTQGPSYSESKRLEFVAARLGAELRNASLRMFGLRVEDEGNYTCLFVTFPQGSRSVDIWLRVLAKPQNTAEVQKVQLTGEPVPMARCVSTGGRPPAQITWHSDLGGMPNTSQVPGFLSGTVTVTSLWILVPSSQVDGKNVTCKVEHESFEKPQLLTVNLTVYYPPEVSISGYDNNWYLGQNEATLTCDARSNPEPTGYNWSTTMGPLPPFAVAQGAQLLIRPVDKPINTTLICNVTNALGARQAELTVQVKEGPPSEHSGISRN

SEQ ID NO: 183 - protein, 323 aa, synthetic construct
  REGION 1..323: note = CD155 v28 ECD
WPPPGTGDVVVQAPTQVPGFLGDSVTLPCYLQVPNMEVTHVAQLTWARHGESGSMAVFHQTQGPSYSESKRLEFVAARLGAELRNASLRMFGLRVEDEGNYTCQFVTFPQRSRSVDIWLRVLAKPQNTAEVQKVQLTGEPVPMARCVSTGGRPPAQITWHSDLGGMPNTSQVPGFLSGTVTVTSLWILVPSSQVDGKNVTCKVEHESFEKPQLLTVNLTVYYPPEVSISGYDNNWYLGQNEATLTCDARSNPEPTGYNWSTTMGPLPPFAVAQGAQLLIRPVDKPINTTLICNVTNALGARQAELTVQVKEGPPSEHSGISRN

SEQ ID NO: 184 - protein, 323 aa, synthetic construct
  REGION 1..323: note = CD155 v39 ECD
WPPPGTGDVVVQAPTQVPGFLGDSVTLPCYLQVPNMEVTHVAQLTWARHGEQGSMAVFHQTQGPSYSESKRLEFVAARLGAELRNASLRMFGLRVEDEGNYTCQFVTFPQRSRSVDIWLRVLAKPQNTAEVQKVQLTGEPVPMARCVSTGGRPPAQITWHSDLGGMPNTSQVPGFLSGTVTVTSLWILVPSSQVDGKNVTCKVEHESFEKPQLLTVNLTVYYPPEVSISGYDNNWYLGQNEATLTCDARSNPEPTGYNWSTTMGPLPPFAVAQGAQLLIRPVDKPINTTLICNVTNALGARQAELTVQVKEGPPSEHSGISRN

SEQ ID NO: 185 - protein, 323 aa, synthetic construct
  REGION 1..323: note = CD155 v30 ECD
WPPPGTGDVVVQAPTQVPGFLGDSVTLPCYLQVPNMEVTHVSQLTWARHGEWGSMAVFHQTQGPSYSESKRLEFVAARLGAELRNASLRMFGLRVEDEGNYTCEFVTFPQGSRSVDIWLRVLAKPQNTAEVQKVQLTGEPVPMARCVSTGGRPPAQITWHSDLGGMPNTSQVPGFLSGTVTVTSLWILVPSSQVDGKNVTCKVEHESFEKPQLLTVNLTVYYPPEVSISGYDNNWYLGQNEATLTCDARSNPEPTGYNWSTTMGPLPPFAVAQGAQLLIRPVDKPINTTLICNVTNALGARQAELTVQVKEGPPSEHSGISRN

SEQ ID NO: 186 - protein, 323 aa, synthetic construct
  REGION 1..323: note = CD155 v31 ECD
WPPPGTGDVVVQAPTQVPGFLGDSVTLPCYLQVPNMEVTHVCQLTWARHGESGSMAVFHQTQGPSYSESKRLEFVAARLGAELRNASLRMFGLRVEDEGNYTCLFVTFPQGSRSVDIWLRVLAKPQNTAEVQKVQLTGEPVPMARCVSTGGRPPAQITWHSDLGGMPNTSQVPGFLSGTVTVTSLWILVPSSQVDGKNVTCKVEHESFEKPQLLTVNLTVYYPPEVSISGYDNNWYLGQNEATLTCDARSNPEPTGYNWSTTMGPLPPFAVAQGAQLLIRPVDKPINTTLICNVTNALGARQAELTVQVKEGPPSEHSGISRN

SEQ ID NO: 187 - protein, 323 aa, synthetic construct
  REGION 1..323: note = CD155 v32 ECD
WPPPGTGDVVVQAPTQVPGFLGDSVTLPCYLQVPNMEVTHVSQLTWARHGEWGSMAVFHQTQGPSYSESKRLEFVAARLGAELRNASLRMFGLRVEDEGNYTCLFVTFPQGSRSVDIWLRVLAKPQNTAEVQKVQLTGEPVPMARCVSTGGRPPAQITWHSDLGGMPNTSQVPGFLSGTVTVTSLWILVPSSQVDGKNVTCKVEHESFEKPQLLTVNLTVYYPPEVSISGYDNNWYLGQNEATLTCDARSNPEPTGYNWSTTMGPLPPFAVAQGAQLLIRPVDKPINTTLICNVTNALGARQAELTVQVKEGPPSEHSGISRN

SEQ ID NO: 188 - protein, 323 aa, synthetic construct
  REGION 1..323: note = CD155 v33 ECD
WPPPGTGDVVVQAPTQVPGFLGDSVTLPCYLQVPNMEVTHVSQLTWARHGEMGSMAVFHQTQGPSYSESKRLEFVAARLGAELRNASLRMFGLRVEDEGNYTCQFVTFPQGSRSVDIWLRVLAKPQNTAEVQKVQLTGEPVPMARCVSTGGRPPAQITWHSDLGGMPNTSQVPGFLSGTVTVTSLWILVPSSQVDGKNVTCKVEHESFEKPQLLTVNLTVYYPPEVSISGYDNNWYLGQNEATLTCDARSNPEPTGYNWSTTMGPLPPFAVAQGAQLLIRPVDKPINTTLICNVTNALGARQAELTVQVKEGPPSEHSGISRN

SEQ ID NO: 189 - protein, 323 aa, synthetic construct
  REGION 1..323: note = CD155 v34 ECD
WPPPGTGDVVVQAPTQVPGFLGDSVTLPCYLQVPNMEVTHVLQLTWARHGELGSMAVFHQTFGPSYSESKRLEFVAARLGAELRNASLRMFGLRVEDEGNYTCQFVTFPQGSRSVDIWLRVLAKPQNTAEVQKVQLTGEPVPMARCVSTGGRPPAQITWHSDLGGMPNTSQVPGFLSGTVTVTSLWILVPSSQVDGKNVTCKVEHESFEKPQLLTVNLTVYYPPEVSISGYDNNWYLGQNEATLTCDARSNPEPTGYNWSTTMGPLPPFAVAQGAQLLIRPVDKPINTTLICNVTNALGARQAELTVQVKEGPPSEHSGISRN

SEQ ID NO: 190 - protein, 323 aa, synthetic construct
  REGION 1..323: note = CD155 v35 ECD
WPPPGTGDVVVQAPTQVPGFLGDSVTLPCYLQVPNMEVTHVWQLTWARHGESGSMAVFHQTQGPSYSESKRLEFVAARLGAELRNASLRMFGLRVEDEGNYTCLFVTFPQGSRSVDIWLRVLAKPQNTAEVQKVQLTGEPVPMARCVSTGGRPPAQITWHSDLGGMPNTSQVPGFLSGTVTVTSLWILVPSSQVDGKNVTCKVEHESFEKPQLLTVNLTVYYPPEVSISGYDNNWYLGQNEATLTCDARSNPEPTGYNWSTTMGPLPPFAVAQGAQLLIRPVDKPINTTLICNVTNALGARQAELTVQVKEGPPSEHSGISRN

SEQ ID NO: 191 - protein, 323 aa, synthetic construct
  REGION 1..323: note = CD155 v36 ECD
WPPPGTGDVVVQAPTQVPGFLGDSVTLPCYLQVPNMEVTHVQQLTWARHGESGSMAVFHQTQGPSYSESKRLEFVAARLGAELRNASLRMFGLRVEDEGNYTCLFVTFPQGSRSVDIWLRVLAKPQNTAEVQKVQLTGEPVPMARCVSTGGRPPAQITWHSDLGGMPNTSQVPGFLSGTVTVTSLWILVPSSQVDGKNVTCKVEHESFEKPQLLTVNLTVYYPPEVSISGYDNNWYLGQNEATLTCDARSNPEPTGYNWSTTMGPLPPFAVAQGAQLLIRPVDKPINTTLICNVTNALGARQAELTVQVKEGPPSEHSGISRN

SEQ ID NO: 192 - protein, 323 aa, synthetic construct
  REGION 1..323: note = CD155 v37 ECD
WPPPGTGDVVVQAPTQVPGFLGDSVTLPCYLQVPNMEVTHVSQLTWARHGELGSMAVFHQTQGPSYSESKRLEFVAARLGAELRNASLRMFGLRVEDEGNYTCLFVTFPQGSRSVDIWLRVLAKPQNTAEVQKVQLTGEPVPMARCVSTGGRPPAQITWHSDLGGMPNTSQVPGFLSGTVTVTSLWILVPSSQVDGKNVTCKVEHESFEKPQLLTVNLTVYYPPEVSISGYDNNWYLGQNEATLTCDARSNPEPTGYNWSTTMGPLPPFAVAQGAQLLIRPVDKPINTTLICNVTNALGARQAELTVQVKEGPPSEHSGISRN

SEQ ID NO: 193 - protein, 323 aa, synthetic construct
  REGION 1..323: note = CD155 v38 ECD
WPPPGTGDVVVQAPTQVPGFLGDSVTLPCYLQVPNMEVTHVSQLTWARHGERGSMAVFHQTQGPSYSESKRLEFVAARLGAELRNASLRMFGLRVEDEGNYTCLFVTFPQGSRSVDIWLRVLAKPQNTAEVQKVQLTGEPVPMARCVSTGGRPPAQITWHSDLGGMPNTSQVPGFLSGTVTVTSLWILVPSSQVDGKNVTCKVEHESFEKPQLLTVNLTVYYPPEVSISGYDNNWYLGQNEATLTCDARSNPEPTGYNWSTTMGPLPPFAVAQGAQLLIRPVDKPINTTLICNVTNALGARQAELTVQVKEGPPSEHSGISRN

SEQ ID NO: 194 - protein, 323 aa, synthetic construct
  REGION 1..323: note = CD155 v39 ECD
WPPPGTGDVVVQAPTQVPGFLGDSVTLPCYLQVPNMEVTHVSQLTWARHGESGSMAVFHQTQGPSYSESKRLEFVAARLGAELRNASLRMFGLRVEDEGNYTCEFVTFPQGSRSVDIWLRVLAKPQNTAEVQKVQLTGEPVPMARCVSTGGRPPAQITWHSDLGGMPNTSQVPGFLSGTVTVTSLWILVPSSQVDGKNVTCKVEHESFEKPQLLTVNLTVYYPPEVSISGYDNNWYLGQNEATLTCDARSNPEPTGYNWSTTMGPLPPFAVAQGAQLLIRPVDKPINTTLICNVTNALGARQAELTVQVKEGPPSEHSGISRN

SEQ ID NO: 195 - protein, 323 aa, synthetic construct
  REGION 1..323: note = CD155 v40 ECD
WPPPGTGDVVVQAPTQVPGFLGDSVTLPCYLQVPNMEVTHVSQLTWARHGESGSMAVFHQTQGPSYSESKRLEFVAARLGAELRNASLRMFGLRVEDEGNYTCLFVTFPQRSRSVDIWLRVLAKPQNTAEVQKVQLTGEPVPMARCVSTGGRPPAQITWHSDLGGMPNTSQVPGFLSGTVTVTSLWILVPSSQVDGKNVTCKVEHESFEKPQLLTVNLTVYYPPEVSISGYDNNWYLGQNEATLTCDARSNPEPTGYNWSTTMGPLPPFAVAQGAQLLIRPVDKPINTTLICNVTNALGARQAELTVQVKEGPPSEHSGISRN

SEQ ID NO: 196 - protein, 323 aa, synthetic construct
  REGION 1..323: note = CD155 v41 ECD
WPPPGTGDVVVQAPTQVPGFLGDSVTLPCYLQVPNMEVTHVSQLTWARHGEEGSMAVFHQTQGPSYSESKRLEFVAARLGAELRNASLRMFGLRVEDEGNYTCLFVTFPQGSRSVDIWLRVLAKPQNTAEVQKVQLTGEPVPMARCVSTGGRPPAQITWHSDLGGMPNTSQVPGFLSGTVTVTSLWILVPSSQVDGKNVTCKVEHESFEKPQLLTVNLTVYYPPEVSISGYDNNWYLGQNEATLTCDARSNPEPTGYNWSTTMGPLPPFAVAQGAQLLIRPVDKPINTTLICNVTNALGARQAELTVQVKEGPPSEHSGISRN

SEQ ID NO: 197 - protein, 323 aa, synthetic construct
  REGION 1..323: note = CD155 v42 ECD
WPPPGTGDVVVQAPTQVPGFLGDSVTLPCYLQVPNMEVTHVSQLTWARHGESGSMAVFHQTYGPSYSESKRLEFVAARLGAELRNASLRMFGLRVEDEGNYTCLFVTFPQGSRSVDIWLRVLAKPQNTAEVQKVQLTGEPVPMARCVSTGGRPPAQITWHSDLGGMPNTSQVPGFLSGTVTVTSLWILVPSSQVDGKNVTCKVEHESFEKPQLLTVNLTVYYPPEVSISGYDNNWYLGQNEATLTCDARSNPEPTGYNWSTTMGPLPPFAVAQGAQLLIRPVDKPINTTLICNVTNALGARQAELTVQVKEGPPSEHSGISRN

SEQ ID NO: 198 - protein, 323 aa, synthetic construct
  REGION 1..323: note = CD155 v43 ECD
WPPPGTGDVVVQAPTQVPGFLGDSVTLPCYLQVPNMEVTHVSQLQWARHGEMGSMAVFHQTQGPSYSESKRLEFVAARLGAELRNASLRMFGLRVEDEGNYTCEFVTFPQGSRSVDIWLRVLAKPQNTAEVQKVQLTGEPVPMARCVSTGGRPPAQITWHSDLGGMPNTSQVPGFLSGTVTVTSLWILVPSSQVDGKNVTCKVEHESFEKPQLLTVNLTVYYPPEVSISGYDNNWYLGQNEATLTCDARSNPEPTGYNWSTTMGPLPPFAVAQGAQLLIRPVDKPINTTLICNVTNALGARQAELTVQVKEGPPSEHSGISRN

SEQ ID NO: 199 - protein, 323 aa, synthetic construct
  REGION 1..323: note = CD155 v44 ECD
WPPPGTGDVVVQAPTQVPGFLGDSVTLPCYLQVPNMEVTHVNQLTWARHGESGSMAVFHQTQGPSYSESKRLEFVAARLGAELRNASLRMFGLRVEDEGNYTCQFVTFPQRSRSVDIWLRVLAKPQNTAEVQKVQLTGEPVPMARCVSTGGRPPAQITWHSDLGGMPNTSQVPGFLSGTVTVTSLWILVPSSQVDGKNVTCKVEHESFEKPQLLTVNLTVYYPPEVSISGYDNNWYLGQNEATLTCDARSNPEPTGYNWSTTMGPLPPFAVAQGAQLLIRPVDKPINTTLICNVTNALGARQAELTVQVKEGPPSEHSGISRN

SEQ ID NO: 200 - protein, 323 aa, synthetic construct
  REGION 1..323: note = CD155 v45 ECD
WPPPGTGDVVVQAPTQVPGFLGDSVTLPCYLQVPNMEVTHVSQLTWARHGEMGSMALFHQTQGPSYSESKRLEFVAARLGAELRNASLRMFGLRVEDEGNYTCLFVTFPQGSRSVDIWLRVLAKPQNTAEVQKVQLTGEPVPMARCVSTGGRPPAQITWHSDLGGMPNTSQVPGFLSGTVTVTSLWILVPSSQVDGKNVTCKVEHESFEKPQLLTVNLTVYYPPEVSISGYDNNWYLGQNEATLTCDARSNPEPTGYNWSTTMGPLPPFAVAQGAQLLIRPVDKPINTTLICNVTNALGARQAELTVQVKEGPPSEHSGISRN

SEQ ID NO: 201 - protein, 323 aa, synthetic construct
  REGION 1..323: note = CD155 v46 ECD
WPPPGTGDVVVQAPTQVPGFLGDSVTLPCYLQVPNMEVTHVNQLTWARHGEQGSMAVFHQTFGPSYSESKRLEFVAARLGAELRNASLRMFGLRVEDEGNYTCLFVTFPQGSRSVDIWLRVLAKPQNTAEVQKVQLTGEPVPMARCVSTGGRPPAQITWHSDLGGMPNTSQVPGFLSGTVTVTSLWILVPSSQVDGKNVTCKVEHESFEKPQLLTVNLTVYYPPEVSISGYDNNWYLGQNEATLTCDARSNPEPTGYNWSTTMGPLPPFAVAQGAQLLIRPVDKPINTTLICNVTNALGARQAELTVQVKEGPPSEHSGISRN

SEQ ID NO: 202 - protein, 323 aa, synthetic construct
  REGION 1..323: note = CD155 v47 ECD
WPPPGTGDVVVQAPTQVPGFLGDSVTLPCYLQVPNMEVTHVAQLTWARHGELGSMAVFHQTQGPSYSESKRLEFVAARLGAELRNASLRMFGLRVEDEGNYTCEFVTFPQRSRSVDIWLRVLAKPQNTAEVQKVQLTGEPVPMARCVSTGGRPPAQITWHSDLGGMPNTSQVPGFLSGTVTVTSLWILVPSSQVDGKNVTCKVEHESFEKPQLLTVNLTVYYPPEVSISGYDNNWYLGQNEATLTCDARSNPEPTGYNWSTTMGPLPPFAVAQGAQLLIRPVDKPINTTLICNVTNALGARQAELTVQVKEGPPSEHSGISRN

SEQ ID NO: 203 - protein, 323 aa, synthetic construct
  REGION 1..323: note = CD155 v48 ECD
WPPPGTGDVVVQAPTQVPGFLGDSVTLPCYLQVPNMEVTHVWQLTWARHGEQGSMALFHQTYGPSYSESKRLEFVAARLGAELRNASLRMFGLRVEDEGNYTCLFVTFPQGSRSVDIWLRVLAKPQNTAEVQKVQLTGEPVPMARCVSTGGRPPAQITWHSDLGGMPNTSQVPGFLSGTVTVTSLWILVPSSQVDGKNVTCKVEHESFEKPQLLTVNLTVYYPPEVSISGYDNNWYLGQNEATLTCDARSNPEPTGYNWSTTMGPLPPFAVAQGAQLLIRPVDKPINTTLICNVTNALGARQAELTVQVKEGPPSEHSGISRN

SEQ ID NO: 204 - protein, 323 aa, synthetic construct
  REGION 1..323: note = CD155 v49 ECD
WPPPGTGDVVVQAPTQVPGFLGDSVTLPCYLQVPNMEVTHVSQLTWARHGESGSMAVFHQTQGPSYSESKRLEFVAARLGAELRNASLRMFGLRVEDEGNYTCQFVTFPQGSRSVDIWLRVLAKPQNTAEVQKVQLTGEPVPMARCVSTGGRPPAQITWHSDLGGMPNTSQVPGFLSGTVTVTSLWILVPSSQVDGKNVTCKVEHESFEKPQLLTVNLTVYYPPEVSISGYDNNWYLGQNEATLTCDARSNPEPTGYNWSTTMGPLPPFAVAQGAQLLIRPVDKPINTTLICNVTNALGARQAELTVQVKEGPPSEHSGISRN

SEQ ID NO: 205 - protein, 323 aa, synthetic construct
  REGION 1..323: note = CD155 v50 ECD
WPPPGTGDVVVQAPTQVPGFLGDSVTLPCYLQVPNMEVTHVLQLTWARHGEQGSMAVFHQTQGPSYSESKRLEFVAARLGAELRNASLRMFGLRVEDEGNYTCEFVTFPQGSRSVDIWLRVLAKPQNTAEVQKVQLTGEPVPMARCVSTGGRPPAQITWHSDLGGMPNTSQVPGFLSGTVTVTSLWILVPSSQVDGKNVTCKVEHESFEKPQLLTVNLTVYYPPEVSISGYDNNWYLGQNEATLTCDARSNPEPTGYNWSTTMGPLPPFAVAQGAQLLIRPVDKPINTTLICNVTNALGARQAELTVQVKEGPPSEHSGISRN

SEQ ID NO: 206 - protein, 323 aa, synthetic construct
  REGION 1..323: note = CD155 v51 ECD
WPPPGTGDVVVQAPTQVPGFLGDSVTLPCYLQVPNMEVTHVCQLTWARHGELGSMAVFHQTQGPSYSESKRLEFVAARLGAELRNASLRMFGLRVEDEGNYTCLFVTFPQGSRSVDIWLRVLAKPQNTAEVQKVQLTGEPVPMARCVSTGGRPPAQITWHSDLGGMPNTSQVPGFLSGTVTVTSLWILVPSSQVDGKNVTCKVEHESFEKPQLLTVNLTVYYPPEVSISGYDNNWYLGQNEATLTCDARSNPEPTGYNWSTTMGPLPPFAVAQGAQLLIRPVDKPINTTLICNVTNALGARQAELTVQVKEGPPSEHSGISRN

SEQ ID NO: 207 - protein, 323 aa, synthetic construct
  REGION 1..323: note = CD155 v52 ECD
WPPPGTGDVVVQAPTQVPGFLGDSVTLPCYLQVPNMEVTHVWQLTWARHGERGSMAVFHQTYGPSYSESKRLEFVAARLGAELRNASLRMFGLRVEDEGNYTCQFVTFPQGSRSVDIWLRVLAKPQNTAEVQKVQLTGEPVPMARCVSTGGRPPAQITWHSDLGGMPNTSQVPGFLSGTVTVTSLWILVPSSQVDGKNVTCKVEHESFEKPQLLTVNLTVYYPPEVSISGYDNNWYLGQNEATLTCDARSNPEPTGYNWSTTMGPLPPFAVAQGAQLLIRPVDKPINTTLICNVTNALGARQAELTVQVKEGPPSEHSGISRN

SEQ ID NO: 208 - protein, 323 aa, synthetic construct
  REGION 1..323: note = CD155 v53 ECD
WPPPGTGDVVVQAPTQVPGFLGDSVTLPCYLQVPNMEVTHVSQLQWARHGERGSMAVFHQTQGPSYSESKRLEFVAARLGAELRNASLRMFGLRVEDEGNYTCEFVTFPQGSRSVDIWLRVLAKPQNTAEVQKVQLTGEPVPMARCVSTGGRPPAQITWHSDLGGMPNTSQVPGFLSGTVTVTSLWILVPSSQVDGKNVTCKVEHESFEKPQLLTVNLTVYYPPEVSISGYDNNWYLGQNEATLTCDARSNPEPTGYNWSTTMGPLPPFAVAQGAQLLIRPVDKPINTTLICNVTNALGARQAELTVQVKEGPPSEHSGISRN

SEQ ID NO: 209 - protein, 323 aa, synthetic construct
  REGION 1..323: note = CD155 v54 ECD
WPPPGTGDVVVQAPTQVPGFLGDSVTLPCYLQVPNMEVTHVSQLTWARHGERGSMAVFHQTFGPSYSESKRLEFVAARLGAELRNASLRMFGLRVEDEGNYTCQFVTFPQRSRSVDIWLRVLAKPQNTAEVQKVQLTGEPVPMARCVSTGGRPPAQITWHSDLGGMPNTSQVPGFLSGTVTVTSLWILVPSSQVDGKNVTCKVEHESFEKPQLLTVNLTVYYPPEVSISGYDNNWYLGQNEATLTCDARSNPEPTGYNWSTTMGPLPPFAVAQGAQLLIRPVDKPINTTLICNVTNALGARQAELTVQVKEGPPSEHSGISRN

SEQ ID NO: 210 - protein, 323 aa, synthetic construct
  REGION 1..323: note = CD155 v55 ECD
WPPPGTGDVVVQAPTQVPGFLGDSVTLPCYLQVPNMEVTHVSQLQWARHGELGSMALFHQTQGPSYSESKRLEFVAARLGAELRNASLRMFGLRVEDEGNYTCEFVTFPQGSRSVDIWLRVLAKPQNTAEVQKVQLTGEPVPMARCVSTGGRPPAQITWHSDLGGMPNTSQVPGFLSGTVTVTSLWILVPSSQVDGKNVTCKVEHESFEKPQLLTVNLTVYYPPEVSISGYDNNWYLGQNEATLTCDARSNPEPTGYNWSTTMGPLPPFAVAQGAQLLIRPVDKPINTTLICNVTNALGARQAELTVQVKEGPPSEHSGISRN

SEQ ID NO: 211 - protein, 323 aa, synthetic construct
  REGION 1..323: note = CD155 v56 ECD
WPPPGTGDVVVQAPTQVPGFLGDSVTLPCYLQVPNMEVTHVSQLTWARHGEMGSMAVFHQTYGPSYSESKRLEFVAARLGAELRNASLRMFGLRVEDEGNYTCLFVTFPQGSRSVDIWLRVLAKPQNTAEVQKVQLTGEPVPMARCVSTGGRPPAQITWHSDLGGMPNTSQVPGFLSGTVTVTSLWILVPSSQVDGKNVTCKVEHESFEKPQLLTVNLTVYYPPEVSISGYDNNWYLGQNEATLTCDARSNPEPTGYNWSTTMGPLPPFAVAQGAQLLIRPVDKPINTTLICNVTNALGARQAELTVQVKEGPPSEHSGISRN

SEQ ID NO: 212 - protein, 323 aa, synthetic construct
  REGION 1..323: note = CD155 v57 ECD
WPPPGTGDVVVQAPTQVPGFLGDSVTLPCYLQVPNMEVTHVSQLTWARHGESGSMAVFHQTFGPSYSESKRLEFVAARLGAELRNASLRMFGLRVEDEGNYTCEFVTFPQRSRSVDIWLRVLAKPQNTAEVQKVQLTGEPVPMARCVSTGGRPPAQITWHSDLGGMPNTSQVPGFLSGTVTVTSLWILVPSSQVDGKNVTCKVEHESFEKPQLLTVNLTVYYPPEVSISGYDNNWYLGQNEATLTCDARSNPEPTGYNWSTTMGPLPPFAVAQGAQLLIRPVDKPINTTLICNVTNALGARQAELTVQVKEGPPSEHSGISRN

SEQ ID NO: 213 - protein, 323 aa, synthetic construct
  REGION 1..323: note = CD155 v58 ECD
WPPPGTGDVVVQAPTQVPGFLGDSVTLPCYLQVPNMEVTHVSQLQWARHGEQGSMAVFHQTQGPSYSESKRLEFVAARLGAELRNASLRMFGLRVEDEGNYTCLFVTFPQGSRSVDIWLRVLAKPQNTAEVQKVQLTGEPVPMARCVSTGGRPPAQITWHSDLGGMPNTSQVPGFLSGTVTVTSLWILVPSSQVDGKNVTCKVEHESFEKPQLLTVNLTVYYPPEVSISGYDNNWYLGQNEATLTCDARSNPEPTGYNWSTTMGPLPPFAVAQGAQLLIRPVDKPINTTLICNVTNALGARQAELTVQVKEGPPSEHSGISRN

SEQ ID NO: 214 - protein, 323 aa, synthetic construct
  REGION 1..323: note = CD155 v59 ECD
WPPPGTGDVVVQAPTQVPGFLGDSVTLPCYLQVPNMEVTHVSQLTWARHGELGSMAVFHQTQGPSYSESKRLEFVAARLGAELRNASLRMFGLRVEDEGNYTCEFVTFPQGSRSVDIWLRVLAKPQNTAEVQKVQLTGEPVPMARCVSTGGRPPAQITWHSDLGGMPNTSQVPGFLSGTVTVTSLWILVPSSQVDGKNVTCKVEHESFEKPQLLTVNLTVYYPPEVSISGYDNNWYLGQNEATLTCDARSNPEPTGYNWSTTMGPLPPFAVAQGAQLLIRPVDKPINTTLICNVTNALGARQAELTVQVKEGPPSEHSGISRN

SEQ ID NO: 215 - protein, 323 aa, synthetic construct
  REGION 1..323: note = CD155 v60 ECD
WPPPGTGDVVVQAPTQVPGFLGDSVTLPCYLQVPNMEVTHVVQLTWARHGEEGSMAVFHQTQGPSYSESKRLEFVAARLGAELRNASLRMFGLRVEDEGNYTCLFVTFPQGSRSVDIWLRVLAKPQNTAEVQKVQLTGEPVPMARCVSTGGRPPAQITWHSDLGGMPNTSQVPGFLSGTVTVTSLWILVPSSQVDGKNVTCKVEHESFEKPQLLTVNLTVYYPPEVSISGYDNNWYLGQNEATLTCDARSNPEPTGYNWSTTMGPLPPFAVAQGAQLLIRPVDKPINTTLICNVTNALGARQAELTVQVKEGPPSEHSGISRN

SEQ ID NO: 216 - protein, 323 aa, synthetic construct
  REGION 1..323: note = CD155 v61 ECD
WPPPGTGDVVVQAPTQVPGFLGDSVTLPCYLQVPNMEVTHVSQLQWARHGERGSMAVFHQTQGPSYSESKRLEFVAARLGAELRNASLRMFGLRVEDEGNYTCLFVTFPQRSRSVDIWLRVLAKPQNTAEVQKVQLTGEPVPMARCVSTGGRPPAQITWHSDLGGMPNTSQVPGFLSGTVTVTSLWILVPSSQVDGKNVTCKVEHESFEKPQLLTVNLTVYYPPEVSISGYDNNWYLGQNEATLTCDARSNPEPTGYNWSTTMGPLPPFAVAQGAQLLIRPVDKPINTTLICNVTNALGARQAELTVQVKEGPPSEHSGISRN

SEQ ID NO: 217 - protein, 323 aa, synthetic construct
  REGION 1..323: note = CD155 v62 ECD
WPPPGTGDVVVQAPTQVPGFLGDSVTLPCYLQVPNMEVTHVGQLTWARHGEQGSMAVFHQTQGPSYSESKRLEFVAARLGAELRNASLRMFGLRVEDEGNYTCEFVTFPQRSRSVDIWLRVLAKPQNTAEVQKVQLTGEPVPMARCVSTGGRPPAQITWHSDLGGMPNTSQVPGFLSGTVTVTSLWILVPSSQVDGKNVTCKVEHESFEKPQLLTVNLTVYYPPEVSISGYDNNWYLGQNEATLTCDARSNPEPTGYNWSTTMGPLPPFAVAQGAQLLIRPVDKPINTTLICNVTNALGARQAELTVQVKEGPPSEHSGISRN

SEQ ID NO: 218 - protein, 323 aa, synthetic construct
  REGION 1..323: note = CD155 v63 ECD
WPPPGTGDVVVQAPTQVPGFLGDSVTLPCYLQVPNMEVTHVNQLTWARHGEEGSMALFHQTQGPSYSESKRLEFVAARLGAELRNASLRMFGLRVEDEGNYTCEFVTFPQGSRSVDIWLRVLAKPQNTAEVQKVQLTGEPVPMARCVSTGGRPPAQITWHSDLGGMPNTSQVPGFLSGTVTVTSLWILVPSSQVDGKNVTCKVEHESFEKPQLLTVNLTVYYPPEVSISGYDNNWYLGQNEATLTCDARSNPEPTGYNWSTTMGPLPPFAVAQGAQLLIRPVDKPINTTLICNVTNALGARQAELTVQVKEGPPSEHSGISRN

SEQ ID NO: 219 - protein, 323 aa, synthetic construct
  REGION 1..323: note = CD155 v64 ECD
WPPPGTGDVVVQAPTQVPGFLGDSVTLPCYLQVPNMEVTHVCQLTWARHGEMGSMAVFHQTFGPSYSESKRLEFVAARLGAELRNASLRMFGLRVEDEGNYTCLFVTFPQGSRSVDIWLRVLAKPQNTAEVQKVQLTGEPVPMARCVSTGGRPPAQITWHSDLGGMPNTSQVPGFLSGTVTVTSLWILVPSSQVDGKNVTCKVEHESFEKPQLLTVNLTVYYPPEVSISGYDNNWYLGQNEATLTCDARSNPEPTGYNWSTTMGPLPPFAVAQGAQLLIRPVDKPINTTLICNVTNALGARQAELTVQVKEGPPSEHSGISRN

SEQ ID NO: 220 - protein, 323 aa, synthetic construct
  REGION 1..323: note = CD155 v65 ECD
WPPPGTGDVVVQAPTQVPGFLGDSVTLPCYLQVPNMEVTHVLQLTWARHGESGSMAVFHQTQGPSYSESKRLEFVAARLGAELRNASLRMFGLRVEDEGNYTCLFVTFPQGSRSVDIWLRVLAKPQNTAEVQKVQLTGEPVPMARCVSTGGRPPAQITWHSDLGGMPNTSQVPGFLSGTVTVTSLWILVPSSQVDGKNVTCKVEHESFEKPQLLTVNLTVYYPPEVSISGYDNNWYLGQNEATLTCDARSNPEPTGYNWSTTMGPLPPFAVAQGAQLLIRPVDKPINTTLICNVTNALGARQAELTVQVKEGPPSEHSGISRN

SEQ ID NO: 221 - protein, 323 aa, synthetic construct
  REGION 1..323: note = CD155 v66 ECD
WPPPGTGDVVVQAPTQVPGFLGDSVTLPCYLQVPNMEVTHVAQLTWARHGESGSMAVFHQTQGPSYSESKRLEFVAARLGAELRNASLRMFGLRVEDEGNYTCLFVTFPQGSRSVDIWLRVLAKPQNTAEVQKVQLTGEPVPMARCVSTGGRPPAQITWHSDLGGMPNTSQVPGFLSGTVTVTSLWILVPSSQVDGKNVTCKVEHESFEKPQLLTVNLTVYYPPEVSISGYDNNWYLGQNEATLTCDARSNPEPTGYNWSTTMGPLPPFAVAQGAQLLIRPVDKPINTTLICNVTNALGARQAELTVQVKEGPPSEHSGISRN

SEQ ID NO: 222 - protein, 323 aa, synthetic construct
  REGION 1..323: note = CD155 v67 ECD
WPPPGTGDVVVQAPTQVPGFLGDSVTLPCYLQVPNMEVTHVGQLTWARHGELGSMAVFHQTFGPSYSESKRLEFVAARLGAELRNASLRMFGLRVEDEGNYTCQFVTFPQGSRSVDIWLRVLAKPQNTAEVQKVQLTGEPVPMARCVSTGGRPPAQITWHSDLGGMPNTSQVPGFLSGTVTVTSLWILVPSSQVDGKNVTCKVEHESFEKPQLLTVNLTVYYPPEVSISGYDNNWYLGQNEATLTCDARSNPEPTGYNWSTTMGPLPPFAVAQGAQLLIRPVDKPINTTLICNVTNALGARQAELTVQVKEGPPSEHSGISRN

SEQ ID NO: 223 - protein, 323 aa, synthetic construct
  REGION 1..323: note = CD155 v68 ECD
WPPPGTGDVVVQAPTQVPGFLGDSVTLPCYLQVPNMEVTHVNQLTWARHGESGSMAVFHQTQGPSYSESKRLEFVAARLGAELRNASLRMFGLRVEDEGNYTCLFVTFPQGSRSVDIWLRVLAKPQNTAEVQKVQLTGEPVPMARCVSTGGRPPAQITWHSDLGGMPNTSQVPGFLSGTVTVTSLWILVPSSQVDGKNVTCKVEHESFEKPQLLTVNLTVYYPPEVSISGYDNNWYLGQNEATLTCDARSNPEPTGYNWSTTMGPLPPFAVAQGAQLLIRPVDKPINTTLICNVTNALGARQAELTVQVKEGPPSEHSGISRN

SEQ ID NO: 224 - protein, 323 aa, synthetic construct
  REGION 1..323: note = CD155 v69 ECD
WPPPGTGDVVVQAPTQVTGFLGDSVTLPCYLQVPNMEVTHVSQLTWARHGESGSMAVFHQTQGPAYVESKRLEFVAARLGAELRNASLRMSGLRVEDEGNYTCLFVTFPQGSRSVDIWLRVLAKPQNTAEVQKVQLTGEPVPMARCVSTGGRPPAQITWHSDLGGMPNTSQVPGFLSGTVTVTSLWILVPSSQVDGKNVTCKVEHESFEKPQLLTVNLTVYYPPEVSISGYDNNWYLGQNEATLTCDARSNPEPTGYNWSTTMGPLPPFAVAQGAQLLIRPVDKPINTTLICNVTNALGARQAELTVQVKEGPPSEHSGISRN

SEQ ID NO: 225 - protein, 323 aa, synthetic construct
  REGION 1..323: note = CD155 v70 ECD
WPPPGTGDVVVQAPTQVFGFLGDSVTLPCYLQVPNMEVAHVSQLQWARHGESGSMAVFHQRQGPNYLESKRLGFVAAGLGAELRNASLRMFGLRVEDEGNYTCLFVTFPQGSRSVDIWLRVLAKPQNTAEVQKVQLTGEPVPMARCVSTGGRPPAQITWHSDLGGMPNTSQVPGFLSGTVTVTSLWILVPSSQVDGKNVTCKVEHESFEKPQLLTVNLTVYYPPEVSISGYDNNWYLGQNEATLTCDARSNPEPTGYNWSTTMGPLPPFAVAQGAQLLIRPVDKPINTTLICNVTNALGARQAELTVQVKEGPPSEHSGISRN

SEQ ID NO: 226 - protein, 323 aa, synthetic construct
  REGION 1..323: note = CD155 v71 ECD
WPPPGTGDVVVQAPTQVTGFLGDSVTLPCYLQVPNMEVTHVSQLQWARHGESGSMAVFHQRQGPNYLESKRLEFVAARLGAELRNASLRMFGLRVEDEGNYTCLFVTFPQGSRSVDIWLRVLAKPQNTAEVQKVQLTGEPVPMARCVSTGGRPPAQITWHSDLGGMPNTSQVPGFLSGTVTVTSLWILVPSSQVDGKNVTCKVEHESFEKPQLLTVNLTVYYPPEVSISGYDNNWYLGQNEATLTCDARSNPEPTGYNWSTTMGPLPPFAVAQGAQLLIRPVDKPINTTLICNVTNALGARQAELTVQVKEGPPSEHSGISRN

SEQ ID NO: 227 - protein, 323 aa, synthetic construct
  REGION 1..323: note = CD155 v72 ECD
WPPPGTGDVVVQAPTQVFGFLGDSVTLPCYLQVPNMEVTHVSQLTWARHGESGSMAVFHQTQGPAYVESKRLEFVAARLGAELRNASLRMSGLRVEDEGNYTCLFVTFPQGSRSVDIWLRVLAKPQNTAEVQKVQLTGEPVPMARCVSTGGRPPAQITWHSDLGGMPNTSQVPGFLSGTVTVTSLWILVPSSQVDGKNVTCKVEHESFEKPQLLTVNLTVYYPPEVSISGYDNNWYLGQNEATLTCDARSNPEPTGYNWSTTMGPLPPFAVAQGAQLLIRPVDKPINTTLICNVTNALGARQAELTVQVKEGPPSEHSGISRN

SEQ ID NO: 228 - protein, 323 aa, synthetic construct
  REGION 1..323: note = CD155 v73 ECD
WPPPGTGDVVVQAPTQVFGFLGDSVTLPCYLQVPNMEVTHVSQLQWARHGESGSMAVFHQRQGPNYLESKRLEFVAARLGAELRNASLRMSGLRVEDEGNYTCPFVTFPQGSRSVDIWLRVLAKPQNTAEVQKVQLTGEPVPMARCVSTGGRPPAQITWHSDLGGMPNTSQVPGFLSGTVTVTSLWILVPSSQVDGKNVTCKVEHESFEKPQLLTVNLTVYYPPEVSISGYDNNWYLGQNEATLTCDARSNPEPTGYNWSTTMGPLPPFAVAQGAQLLIRPVDKPINTTLICNVTNALGARQAELTVQVKEGPPSEHSGISRN

SEQ ID NO: 229 - protein, 323 aa, synthetic construct
  REGION 1..323: note = CD155 v74 ECD
WPPPGTGDVVVQAPTQVSGFLGDSVTLPCYLQVPNMEVTHVSQLTWARHGESGSMAVFHQTQGPSYSESKRLEFVAARPGAELRNASLRMFGLRVEDEGNYTCMFVTFPQGSRSVDIWLRVLAKPQNTAEVQKVQLTGEPVPMARCVSTGGRPPAQITWHSDLGGMPNTSQVPGFLSGTVTVTSLWILVPSSQVDGKNVTCKVEHESFEKPQLLTVNLTVYYPPEVSISGYDNNWYLGQNEATLTCDARSNPEPTGYNWSTTMGPLPPFAVAQGAQLLIRPVDKPINTTLICNVTNALGARQAELTVQVKEGPPSEHSGISRN

SEQ ID NO: 230 - protein, 323 aa, synthetic construct
  REGION 1..323: note = CD155 v75 ECD
WPPPGTGDVVVQAPTQVSGFLGDSVTLPCYLQVPNMEVTHVSQLTWARHGESGSMAVFHQTQGPSYSESKRLEFVAARLGAELRNASLRMFGLRVEDEGNYTCMFVTFPQGSRSVDIWLRVLAKPQNTAEVQKVQLTGEPVPMARCVSTGGRPPAQITWHSDLGGMPNTSQVPGFLSGTVTVTSLWILVPSSQVDGKNVTCKVEHESFEKPQLLTVNLTVYYPPEVSISGYDNNWYLGQNEATLTCDARSNPEPTGYNWSTTMGPLPPFAVAQGAQLLIRPVDKPINTTLICNVTNALGARQAELTVQVKEGPPSEHSGISRN

SEQ ID NO: 231 - protein, 323 aa, synthetic construct
  REGION 1..323: note = CD155 v76 ECD
WPPPGTGDVVVQAPTQVPGFLGDSVTLPCYLQVPNMEVTHVSQLTWARHGESGSMAVFHQTQGPSYSESKRLEFVAARPGAELRNASLRMFGLRVEDEGNYTCMFVTFPQGSRSVDIWLRVLAKPQNTAEVQKVQLTGEPVPMARCVSTGGRPPAQITWHSDLGGMPNTSQVPGFLSGTVTVTSLWILVPSSQVDGKNVTCKVEHESFEKPQLLTVNLTVYYPPEVSISGYDNNWYLGQNEATLTCDARSNPEPTGYNWSTTMGPLPPFAVAQGAQLLIRPVDKPINTTLICNVTNALGARQAELTVQVKEGPPSEHSGISRN

SEQ ID NO: 232 - protein, 323 aa, synthetic construct
  REGION 1..323: note = CD155 v77 ECD
WPPPGTGDVVVQAPTQVTGFLGDSVTLPCYLQVPNMEVTHVSQLQWARHGESGSMAVFHQTQGPSYSESKRLEFVAARPGAELRNASLRMFGLRVEDEGNYTCLFVTFPQGSRSVDIWLRVLAKPQNTAEVQKVQLTGEPVPMARCVSTGGRPPAQITWHSDLGGMPNTSQVPGFLSGTVTVTSLWILVPSSQVDGKNVTCKVEHESFEKPQLLTVNLTVYYPPEVSISGYDNNWYLGQNEATLTCDARSNPEPTGYNWSTTMGPLPPFAVAQGAQLLIRPVDKPINTTLICNVTNALGARQAELTVQVKEGPPSEHSGISRN

SEQ ID NO: 233 - protein, 323 aa, synthetic construct
  REGION 1..323: note = CD155 v78 ECD
WPPPGTGDVVVQAPTQVTGFLGDSVTLPCYLQVPNMEVTHVSQLQWARHGESGSMAVFHQRQGPHYHESKRLEFVAARLGAELRNASLRMFGLRVEDEGNYTCLFVTFPQGSRSVDIWLRVLAKPQNTAEVQKVQLTGEPVPMARCVSTGGRPPAQITWHSDLGGMPNTSQVPGFLSGTVTVTSLWILVPSSQVDGKNVTCKVEHESFEKPQLLTVNLTVYYPPEVSISGYDNNWYLGQNEATLTCDARSNPEPTGYNWSTTMGPLPPFAVAQGAQLLIRPVDKPINTTLICNVTNALGARQAELTVQVKEGPPSEHSGISRN

SEQ ID NO: 234 - protein, 323 aa, synthetic construct
  REGION 1..323: note = CD155 v79 ECD
WPPPGTGDVVVQAPTQVTGFLGDSVTLPCYLQVPNMEVTHVSQLTWARHGESGSMAVFHQTQGPSYSESKRLEFVAARLGEELRNASLRMFGLRVEDEGNYTCLFVTFPQGSRSVDIWLRVLAKPQNTAEVQKVQLTGEPVPMARCVSTGGRPPAQITWHSDLGGMPNTSQVPGFLSGTVTVTSLWILVPSSQVDGKNVTCKVEHESFEKPQLLTVNLTVYYPPEVSISGYDNNWYLGQNEATLTCDARSNPEPTGYNWSTTMGPLPPFAVAQGAQLLIRPVDKPINTTLICNVTNALGARQAELTVQVKEGPPSEHSGISRN

SEQ ID NO: 235 - protein, 323 aa, synthetic construct
  REGION 1..323: note = CD155 v80 ECD
WPPPGTGDVVVQAPTQVSGFLGYSVTLPCYLQVPNMPVTHVSQLTWARHGEGGSMAVFHQTMGPSYSESKRLEFVAARLSPELRNASLRMFGLRVEDEYNYTCLFVTFPQGNRSVDIWLRVLAKPQNTAEVQKVQLTGEPVPMARCVSTGGRPPAQITWHSDLGGMPNTSQVPGFLSGTVTVTSLWILVPSSQVDGKNVTCKVEHESFEKPQLLTVNLTVYYPPEVSISGYDNNWYLGQNEATLTCDARSNPEPTGYNWSTTMGPLPPFAVAQGAQLLIRPVDKPINTTLICNVTNALGARQAELTVQVKEGPPSEHSGISRN

SEQ ID NO: 236 - protein, 323 aa, synthetic construct
  REGION 1..323: note = CD155 v81 ECD
WPPPGTGDVVVQRPTQVPGFLGYSVTLPCYLQVPNMPVTHVPQLTWARHGESGSMAVFHQTYGPSYSESKRLEFVAARLGEELRNASLRMFGLRVEDEGNYTCLFVTFPQGSRSVDIWLRVLAKPQNTAEVQKVQLTGEPVPMARCVSTGGRPPAQITWHSDLGGMPNTSQVPGFLSGTVTVTSLWILVPSSQVDGKNVTCKVEHESFEKPQLLTVNLTVYYPPEVSISGYDNNWYLGQNEATLTCDARSNPEPTGYNWSTTMGPLPPFAVAQGAQLLIRPVDKPINTTLICNVTNALGARQAELTVQVKEGPPSEHSGISRN

SEQ ID NO: 237 - protein, 323 aa, synthetic construct
  REGION 1..323: note = CD155 v82 ECD
WPPPGTGDVVVQRPTQVPGFLGYSVTLPCYLQVPNMPVTHVSQLTWARHGESGSMAVFHQTQGPSYSESKRLEFVAARLGAELRNASLRMFGLRVEDEYNYTCLFVTFPQGNRSVDIWLRVLAKPQNTAEVQKVQLTGEPVPMARCVSTGGRPPAQITWHSDLGGMPNTSQVPGFLSGTVTVTSLWILVPSSQVDGKNVTCKVEHESFEKPQLLTVNLTVYYPPEVSISGYDNNWYLGQNEATLTCDARSNPEPTGYNWSTTMGPLPPFAVAQGAQLLIRPVDKPINTTLICNVTNALGARQAELTVQVKEGPPSEHSGISRN

SEQ ID NO: 238 - protein, 323 aa, synthetic construct
  REGION 1..323: note = CD155 v83 ECD
WPPPGTGDVVVQRPTQVPGFLGYSVTLPCYLQVPNMPVTHVSQLTWARHGESGSMAVFHQTMGPSYSESKRLEFVAVRLSPELRNASLRMFGLRVEDEYNYTCLFVTFPQGSRSVDIWLRVLAKPQNTAEVQKVQLTGEPVPMARCVSTGGRPPAQITWHSDLGGMPNTSQVPGFLSGTVTVTSLWILVPSSQVDGKNVTCKVEHESFEKPQLLTVNLTVYYPPEVSISGYDNNWYLGQNEATLTCDARSNPEPTGYNWSTTMGPLPPFAVAQGAQLLIRPVDKPINTTLICNVTNALGARQAELTVQVKEGPPSEHSGISRN

SEQ ID NO: 239 - protein, 323 aa, synthetic construct
  REGION 1..323: note = CD155 v84 ECD
WPPPGTGDVVVQAPTQVLGFLGDSVTLPCYLQVPNMSVTHVSQLTWARHGESGSMAVFHQTMGPSYSESKRLEFVAARLSPELRNASLRMFGLRVEDEYNYTCLFVTFPQGNRSVDIWLRVLAKPQNTAEVQKVQLTGEPVPMARCVSTGGRPPAQITWHSDLGGMPNTSQVPGFLSGTVTVTSLWILVPSSQVDGKNVTCKVEHESFEKPQLLTVNLTVYYPPEVSISGYDNNWYLGQNEATLTCDARSNPEPTGYNWSTTMGPLPPFAVAQGAQLLIRPVDKPINTTLICNVTNALGARQAELTVQVKEGPPSEHSGISRN

SEQ ID NO: 240 - protein, 323 aa, synthetic construct
  REGION 1..323: note = CD155 v85 ECD
WPPPGTGDVVVQAPTQVSGFLGDSVTLPCYLQVPNMEVTHVSQLTWARHGESGSMAVFHQTQGPSYSESKRLEFVAARLGAELRNASLRMFGLRVEDEGNYTCTFVTFPQGSRSVDIWLRVLAKPQNTAEVQKVQLTGEPVPMARCVSTGGRPPAQITWHSDLGGMPNTSQVPGFLSGTVTVTSLWILVPSSQVDGKNVTCKVEHESFEKPQLLTVNLTVYYPPEVSISGYDNNWYLGQNEATLTCDARSNPEPTGYNWSTTMGPLPPFAVAQGAQLLIRPVDKPINTTLICNVTNALGARQAELTVQVKEGPPSEHSGISRN

SEQ ID NO: 241 - protein, 323 aa, synthetic construct
  REGION 1..323: note = CD155 v86 ECD
WPPPGTGDVVVQAPTQVSGFLGDSVTLPCYLQVPNMEVTHVSQLTWARHGESGSMAVFHQTHGPSYSESKRLEFVAARQGAELRNASLRMSGLRVEDEGNYTCLFVTFPQGSRSVDIWLRVLAKPQNTAEVQKVQLTGEPVPMARCVSTGGRPPAQITWHSDLGGMPNTSQVPGFLSGTVTVTSLWILVPSSQVDGKNVTCKVEHESFEKPQLLTVNLTVYYPPEVSISGYDNNWYLGQNEATLTCDARSNPEPTGYNWSTTMGPLPPFAVAQGAQLLIRPVDKPINTTLICNVTNALGARQAELTVQVKEGPPSEHSGISRN

SEQ ID NO: 242 - protein, 323 aa, synthetic construct
  REGION 1..323: note = CD155 v87 ECD
WPPPGTGDVVVQAPTQVPGFLGDSVTLPCYLQVPNMEVTHVSQLQWARHGEKGSMAVFHQTFGPSYSESKRLEFVAARLGAELRNASLRMFGLRVEDEGNYTCQFVTFPQRSRSVDIWLRVLAKPQNTAEVQKVQLTGEPVPMARCVSTGGRPPAQITWHSDLGGMPNTSQVPGFLSGTVTVTSLWILVPSSQVDGKNVTCKVEHESFEKPQLLTVNLTVYYPPEVSISGYDNNWYLGQNEATLTCDARSNPEPTGYNWSTTMGPLPPFAVAQGAQLLIRPVDKPINTTLICNVTNALGARQAELTVQVKEGPPSEHSGISRN

SEQ ID NO: 243 - protein, 323 aa, synthetic construct
  REGION 1..323: note = CD155 v88 ECD
WPPPGTGDVVVQAPTQVPGFLGDSVTLPCYLQVPNMEVTHVSQLQWARHGEQGSMAVFHQTYGPSYSESKRLEFVAARLGAELRNASLRMFGLRVEDEGNYTCQFVTFPQRSRSVDIWLRVLAKPQNTAEVQKVQLTGEPVPMARCVSTGGRPPAQITWHSDLGGMPNTSQVPGFLSGTVTVTSLWILVPSSQVDGKNVTCKVEHESFEKPQLLTVNLTVYYPPEVSISGYDNNWYLGQNEATLTCDARSNPEPTGYNWSTTMGPLPPFAVAQGAQLLIRPVDKPINTTLICNVTNALGARQAELTVQVKEGPPSEHSGISRN

SEQ ID NO: 244 - protein, 323 aa, synthetic construct
  REGION 1..323: note = CD155 v89 ECD
WPPPGTGDVVVQAPTQVPGFLGDSVTLPCYLQVPNMEVTHVSQLQWARHGEQGSMAVFHQTYGPSYSESKRLEFVAARLGAELRNASLRMFGLRVEDEGNYTCEFVTFPQRSRSVDIWLRVLAKPQNTAEVQKVQLTGEPVPMARCVSTGGRPPAQITWHSDLGGMPNTSQVPGFLSGTVTVTSLWILVPSSQVDGKNVTCKVEHESFEKPQLLTVNLTVYYPPEVSISGYDNNWYLGQNEATLTCDARSNPEPTGYNWSTTMGPLPPFAVAQGAQLLIRPVDKPINTTLICNVTNALGARQAELTVQVKEGPPSEHSGISRN

SEQ ID NO: 245 - protein, 323 aa, synthetic construct
  REGION 1..323: note = CD155 v90 ECD
WPPPGTGDVVVQAPTQVPGFLGDSVTLPCYLQVPNMEVTHVSQLTWARHGESGSMAAFHQMQGPWYAESKRLEFVAARLGAELRNASLRMFGLRVDDEGNYTCTFVTFPQGSRSVDIWLRVLAKPQNTAEVQKVQLTGEPVPMARCVSTGGRPPAQITWHSDLGGMPNTSQVPGFLSGTVTVTSLWILVPSSQVDGKNVTCKVEHESFEKPQLLTVNLTVYYPPEVSISGYDNNWYLGQNEATLTCDARSNPEPTGYNWSTTMGPLPPFAVAQGAQLLIRPVDKPINTTLICNVTNALGARQAELTVQVKEGPPSEHSGISRN

SEQ ID NO: 246 - protein, 323 aa, synthetic construct
  REGION 1..323: note = CD155 v91 ECD
WPPPGTGDVVVQAPTQVLGFLGDSVTLPCYLQVPNMEVTHVSQLTWARHGESGSMATFHQSQGPYYAESKRLEFVAARLGAELRNASLRMFGLRVEDEGNYTCTFVTFPQGSRSVDIWLRVLAKPQNTAEVQKVQLTGEPVPMARCVSTGGRPPAQITWHSDLGGMPNTSQVPGFLSGTVTVTSLWILVPSSQVDGKNVTCKVEHESFEKPQLLTVNLTVYYPPEVSISGYDNNWYLGQNEATLTCDARSNPEPTGYNWSTTMGPLPPFAVAQGAQLLIRPVDKPINTTLICNVTNALGARQAELTVQVKEGPPSEHSGISRN

SEQ ID NO: 247 - protein, 323 aa, synthetic construct
  REGION 1..323: note = CD155 v92 ECD
WPPPGTGDVVVQAPTQVTGFLGDSVTLPCYLQVPNMEVTHVSQLQWARHGESGSMAVFHQTQGPSYSESKRLEFVAARLGAELRNASLRMFGLRVEDEGNYTCLFVTFPQGSRSVDIWLRVLAKPQNTAEVQKVQLTGEPVPMARCVSTGGRPPAQITWHSDLGGMPNTSQVPGFLSGTVTVTSLWILVPSSQVDGKNVTCKVEHESFEKPQLLTVNLTVYYPPEVSISGYDNNWYLGQNEATLTCDARSNPEPTGYNWSTTMGPLPPFAVAQGAQLLIRPVDKPINTTLICNVTNALGARQAELTVQVKEGPPSEHSGISRN

SEQ ID NO: 248 - protein, 323 aa, synthetic construct
  REGION 1..323: note = CD155 v94 ECD
WPPPGTGDVVVQAPTQVLGFLGDSVTLPCYLQVPNMEVTHVSQLTWARHGESGSMAAFHQMQGPWYAESKRLEFVAARLGAELRNASLRMFGLRVEDEGNYTCTFVTFPQGSRSVDIWLRVLAKPQNTAEVQKVQLTGEPVPMARCVSTGGRPPAQITWHSDLGGMPNTSQVPGFLSGTVTVTSLWILVPSSQVDGKNVTCKVEHESFEKPQLLTVNLTVYYPPEVSISGYDNNWYLGQNEATLTCDARSNPEPTGYNWSTTMGPLPPFAVAQGAQLLIRPVDKPINTTLICNVTNALGARQAELTVQVKEGPPSEHSGISRN

SEQ ID NO: 249 - protein, 323 aa, synthetic construct
  REGION 1..323: note = CD155 v94 ECD
WPPPGTGDVVVQAPTQVPGFLGDSVTLPCYLQVPNMEVTHVSQLTWARHGESGSMAVFHQMQGPWYAESKRLEFVAARLGAELRNASLRMFGLRVEDEGNYTCTFVTFPQGSRSVDIWLRVLAKPQNTAEVQKVQLTGEPVPMARCVSTGGRPPAQITWHSDLGGMPNTSQVPGFLSGTVTVTSLWILVPSSQVDGKNVTCKVEHESFEKPQLLTVNLTVYYPPEVSISGYDNNWYLGQNEATLTCDARSNPEPTGYNWSTTMGPLPPFAVAQGAQLLIRPVDKPINTTLICNVTNALGARQAELTVQVKEGPPSEHSGISRN

SEQ ID NO: 250 - protein, 323 aa, synthetic construct
  REGION 1..323: note = CD155 v94 ECD
WPPPGTGDVVVQAPTQVSGFLGDSVTLPCYLQVPNMEVTHAGQLGWARHGESGSMAVFHQTQGPSYSESKRLEFVAARLGAELRNASLRMFGLRVEDEGNYTCNFVTFPQGSRSVDIWLRVLAKPQNTAEVQKVQLTGEPVPMARCVSTGGRPPAQITWHSDLGGMPNTSQVPGFLSGTVTVTSLWILVPSSQVDGKNVTCKVEHESFEKPQLLTVNLTVYYPPEVSISGYDNNWYLGQNEATLTCDARSNPEPTGYNWSTTMGPLPPFAVAQGAQLLIRPVDKPINTTLICNVTNALGARQAELTVQVKEGPPSEHSGISRN

SEQ ID NO: 251 - protein, 323 aa, synthetic construct
  REGION 1..323: note = CD155 v96 ECD
WPPPGTGDVVVQAPTQVHGFLGDSVTLPCYLQVPNMEVTHVGQLIWARHGETRHMALFEQSQGPDYSGSKRLEFVAARLGAELRNASLRMFGLRVEDEGNYTCNFVTFPQGSRSVDIWLRVLAKPQNTAEVQKVQLTGEPVPMARCVSTGGRPPAQITWHSDLGGMPNTSQVPGFLSGTVTVTSLWILVPSSQVDGKNVTCKVEHESFEKPQLLTVNLTVYYPPEVSISGYDNNWYLGQNEATLTCDARSNPEPTGYNWSTTMGPLPPFAVAQGAQLLIRPVDKPINTTLICNVTNALGARQAELTVQVKEGPPSEHSGISRN

SEQ ID NO: 252 - protein, 323 aa, synthetic construct
  REGION 1..323: note = CD155 v97 ECD
WPPPGTGDVVVQAPTQVSGFLGDSVTLPCYLQVPNMEVTHVGQLVWARHGESGSMAVLHQTQGPSYWESKRLEFVAARLGAELRNASLRMFGLRVEDEGNYTCNFVTFPQGSRSVDIWLRVLAKPQNTAEVQKVQLTGEPVPMARCVSTGGRPPAQITWHSDLGGMPNTSQVPGFLSGTVTVTSLWILVPSSQVDGKNVTCKVEHESFEKPQLLTVNLTVYYPPEVSISGYDNNWYLGQNEATLTCDARSNPEPTGYNWSTTMGPLPPFAVAQGAQLLIRPVDKPINTTLICNVTNALGARQAELTVQVKEGPPSEHSGISRN

SEQ ID NO: 253 - protein, 323 aa, synthetic construct
  REGION 1..323: note = CD155 v98 ECD
WPPPGTGDVVVQAPTQVSGFLGDSVTLPCYLQVPNMEVTHVSQLIWARHGESGSMAVFHQTQGPSYSESKRLEFVAARLGAELRNASLRMFGLRVEDEGNYTCNFVTFPQGSRSVDIWLRVLAKPQNTAEVQKVQLTGEPVPMARCVSTGGRPPAQITWHSDLGGMPNTSQVPGFLSGTVTVTSLWILVPSSQVDGKNVTCKVEHESFEKPQLLTVNLTVYYPPEVSISGYDNNWYLGQNEATLTCDARSNPEPTGYNWSTTMGPLPPFAVAQGAQLLIRPVDKPINTTLICNVTNALGARQAELTVQVKEGPPSEHSGISRN

SEQ ID NO: 254 - protein, 323 aa, synthetic construct
  REGION 1..323: note = CD155 v99 ECD
WPPPGTGDVVVQAPTQVSGFLGDSVTLPCYLQVPNMEVTHVGQLGWARHGESGSMAVFHQTQGPSYSESKRLEFVAARLGAELRNASLRMFGLRVEDEGNYTCNFATFPQGSRSVDIWLRVLAKPQNTAEVQKVQLTGEPVPMARCVSTGGRPPAQITWHSDLGGMPNTSQVPGFLSGTVTVTSLWILVPSSQVDGKNVTCKVEHESFEKPQLLTVNLTVYYPPEVSISGYDNNWYLGQNEATLTCDARSNPEPTGYNWSTTMGPLPPFAVAQGAQLLIRPVDKPINTTLICNVTNALGARQAELTVQVKEGPPSEHSGISRN

SEQ ID NO: 255 - protein, 323 aa, synthetic construct
  REGION 1..323: note = CD155 v100 ECD
WPPPGTGDVVVQAPTQVHGFLGDSVTLPCYLQVPNMEVTRVGQLIWARHGETRHMALFEQSQGPDYSGSKRLEFVAARLGAELRNASLRMFGLRVEDEGNYTCYFLTHPQGSRSVDIWLRVLAKPQNTAEVQKVQLTGEPVPMARCVSTGGRPPAQITWHSDLGGMPNTSQVPGFLSGTVTVTSLWILVPSSQVDGKNVTCKVEHESFEKPQLLTVNLTVYYPPEVSISGYDNNWYLGQNEATLTCDARSNPEPTGYNWSTTMGPLPPFAVAQGAQLLIRPVDKPINTTLICNVTNALGARQAELTVQVKEGPPSEHSGISRN

SEQ ID NO: 256 - protein, 323 aa, synthetic construct
  REGION 1..323: note = CD155 v101 ECD
WPPPGTGDVVVQAPTQVPGFLGDSVTLPCYLQVPNMVVTHVGQLGWARHGESGSMAVFHQTQGPSYSESKRLEFVAARLGAELRNASLRMFGLRVEDEGNYTCNFVTFPQGSRSVDIWLRVLAKPQNTAEVQKVQLTGEPVPMARCVSTGGRPPAQITWHSDLGGMPNTSQVPGFLSGTVTVTSLWILVPSSQVDGKNVTCKVEHESFEKPQLLTVNLTVYYPPEVSISGYDNNWYLGQNEATLTCDARSNPEPTGYNWSTTMGPLPPFAVAQGAQLLIRPVDKPINTTLICNVTNALGARQAELTVQVKEGPPSEHSGISRN

SEQ ID NO: 257 - protein, 323 aa, synthetic construct
  REGION 1..323: note = CD155 v102 ECD
WPPPGTGDVVVQAPTQVSGFLGDSVTLPCYLQVPNMEVTHVSQLQWARHGESGSMAVFHQTQGPSYSESKRLEFVAARPGAELRNASLRMFGLRVEDEGNYTCTFVTFPQGSRSVDIWLRVLAKPQNTAEVQKVQLTGEPVPMARCVSTGGRPPAQITWHSDLGGMPNTSQVPGFLSGTVTVTSLWILVPSSQVDGKNVTCKVEHESFEKPQLLTVNLTVYYPPEVSISGYDNNWYLGQNEATLTCDARSNPEPTGYNWSTTMGPLPPFAVAQGAQLLIRPVDKPINTTLICNVTNALGARQAELTVQVKEGPPSEHSGISRN

SEQ ID NO: 258 - protein, 323 aa, synthetic construct
  REGION 1..323: note = CD155 v103 ECD
WPPPGTGDVVVQAPTQVLGFLGDSVTLPCYLQVPNMEVTHVSQLTWARHGESGSMAVFHQTRGPSYSESKRLEFVAARLGAELRNASLRMFGLRVEDEGNYTCLFVTFPQGSRSVDIWLRVLAKPQNTAEVQKVQLTGEPVPMARCVSTGGRPPAQITWHSDLGGMPNTSQVPGFLSGTVTVTSLWILVPSSQVDGKNVTCKVEHESFEKPQLLTVNLTVYYPPEVSISGYDNNWYLGQNEATLTCDARSNPEPTGYNWSTTMGPLPPFAVAQGAQLLIRPVDKPINTTLICNVTNALGARQAELTVQVKEGPPSEHSGISRN

SEQ ID NO: 259 - protein, 323 aa, synthetic construct
  REGION 1..323: note = CD155 v104 ECD
WPPPGTGDVVVQRPTQVPGFLGYSVTLPCYLQVPNMPVTHVLQLTWARHGEGGSMAVFHQTYGPSYSESKRLEFVAARLGEELRNASLRMFGLRVEDEGNYTCLFVTFPQGSRSVDIWLRVLAKPQNTAEVQKVQLTGEPVPMARCVSTGGRPPAQITWHSDLGGMPNTSQVPGFLSGTVTVTSLWILVPSSQVDGKNVTCKVEHESFEKPQLLTVNLTVYYPPEVSISGYDNNWYLGQNEATLTCDARSNPEPTGYNWSTTMGPLPPFAVAQGAQLLIRPVDKPINTTLICNVTNALGARQAELTVQVKEGPPSEHSGISRN

SEQ ID NO: 260 - protein, 323 aa, synthetic construct
  REGION 1..323: note = CD155 v105 ECD
WPPPGTGDVVVQAPTQVLGFLGDSVTLPCYLQVPNMEVTHVSQLTWARRGESGSMAVFHQTQGPSYSESKRLEFVAARLGAELRNASLRMFGLRVEDEGNYTCTFVTFPQGSRSVNIWLRVLAKPQNTAEVQKVQLTGEPVPMARCVSTGGRPPAQITWHSDLGGMPNTSQVPGFLSGTVTVTSLWILVPSSQVDGKNVTCKVEHESFEKPQLLTVNLTVYYPPEVSISGYDNNWYLGQNEATLTCDARSNPEPTGYNWSTTMGPLPPFAVAQGAQLLIRPVDKPINTTLICNVTNALGARQAELTVQVKEGPPSEHSGISRN

SEQ ID NO: 261 - protein, 323 aa, synthetic construct
  REGION 1..323: note = CD155 v106 ECD
WPPPGTGDVVVQRPTQVPGFLGYSVTLPCYLQVPNMPVTHVSQLTWARHGESGSMAVFHQTMGPSYSESKRLEFVAARLSPELRNASLRMFGLRVEDEGNYTCTFVTFPQGSRSVDIWLRVLAKPQNTAEVQKVQLTGEPVPMARCVSTGGRPPAQITWHSDLGGMPNTSQVPGFLSGTVTVTSLWILVPSSQVDGKNVTCKVEHESFEKPQLLTVNLTVYYPPEVSISGYDNNWYLGQNEATLTCDARSNPEPTGYNWSTTMGPLPPFAVAQGAQLLIRPVDKPINTTLICNVTNALGARQAELTVQVKEGPPSEHSGISRN

SEQ ID NO: 262 - protein, 323 aa, synthetic construct
  REGION 1..323: note = CD155 v107 ECD
WPPPGTGDVVVQAPTQVPGFLGDSVTLPCYLQVPNMEVTHVSQLTWARHGESGSMAVFHQTQGPTYSESKRLEFVAARLGAELRNASLRMFGLRVEDEGNYTCTFVTFPQGSRSVDIWLRVLAKPQNTAEVQKVQLTGEPVPMARCVSTGGRPPAQITWHSDLGGMPNTSQVPGFLSGTVTVTSLWILVPSSQVDGKNVTCKVEHESFEKPQLLTVNLTVYYPPEVSISGYDNNWYLGQNEATLTCDARSNPEPTGYNWSTTMGPLPPFAVAQGAQLLIRPVDKPINTTLICNVTNALGARQAELTVQVKEGPPSEHSGISRN

SEQ ID NO: 263 - protein, 323 aa, synthetic construct
  REGION 1..323: note = CD155 v108 ECD
WPPPGTGDVVVQRPTQVPGFLGYSVTLPCYLQVPNMPVTHVSQLTWARHGEGGSMAAFHQTMGPSYSESERLEFVAARLGAELRNASLRMFGLRVEDEGNYTCTFVTFPQGSRSVDIWLRVLAKPQNTAEVQKVQLTGEPVPMARCVSTGGRPPAQITWHSDLGGMPNTSQVPGFLSGTVTVTSLWILVPSSQVDGKNVTCKVEHESFEKPQLLTVNLTVYYPPEVSISGYDNNWYLGQNEATLTCDARSNPEPTGYNWSTTMGPLPPFAVAQGAQLLIRPVDKPINTTLICNVTNALGARQAELTVQVKEGPPSEHSGISRN

SEQ ID NO: 264 - protein, 323 aa, synthetic construct
  REGION 1..323: note = CD155 v109 ECD
WPPPGTGDVVVQAPTQVLGFLGDSVTLPCYLQVPNMEVTHVSQLTWVRHGESGSMAVFHQTYGPSYSESKRLDFVAARLGAELRNASLRMFGLRVEDEGNYTCTFVTFPQGSRSVDIWLRVLAKPQNTAEVQKVQLTGEPVPMARCVSTGGRPPAQITWHSDLGGMPNTSQVPGFLSGTVTVTSLWILVPSSQVDGKNVTCKVEHESFEKPQLLTVNLTVYYPPEVSISGYDNNWYLGQNEATLTCDARSNPEPTGYNWSTTMGPLPPFAVAQGAQLLIRPVDKPINTTLICNVTNALGARQAELTVQVKEGPPSEHSGISRN

SEQ ID NO: 265 - protein, 323 aa, synthetic construct
  REGION 1..323: note = CD155 v110 ECD
WPPPGTGDVVVQAPTQVPGFLGDSVTLPCYLQVPNMEVTTMSQLTWVRHGEQGSMAVFHQTLGPTYSESKRLRFVAARLGAELRNASLRMFGLRVEGSGNYTCTFVTFPQGSRSVNIWLRVLAKPQNTAEVQKVQLTGEPVPMARCVSTGGRPPAQITWHSDLGGMPNTSQVPGFLSGTVTVTSLWILVPSSQVDGKNVTCKVEHESFEKPQLLTVNLTVYYPPEVSISGYDNNWYLGQNEATLTCDARSNPEPTGYNWSTTMGPLPPFAVAQGAQLLIRPVDKPINTTLICNVTNALGARQAELTVQVKEGPPSEHSGISRN

SEQ ID NO: 266 - protein, 323 aa, synthetic construct
  REGION 1..323: note = CD155 v111 ECD
WPPPGTGDVVVQAPTQVLGFLGDSVTLPCYLQVPNMEVTHVPQLQWARHGESGSMAVFHQGQGPHYEESKRLEFVAARLGAELRNASLRMFGLRVEDEGNYTCTFVTFPQGSRSVNIWLRVLAKPQNTAEVQKVQLTGEPVPMARCVSTGGRPPAQITWHSDLGGMPNTSQVPGFLSGTVTVTSLWILVPSSQVDGKNVTCKVEHESFEKPQLLTVNLTVYYPPEVSISGYDNNWYLGQNEATLTCDARSNPEPTGYNWSTTMGPLPPFAVAQGAQLLIRPVDKPINTTLICNVTNALGARQAELTVQVKEGPPSEHSGISRN

SEQ ID NO: 267 - protein, 323 aa, synthetic construct
  REGION 1..323: note = CD155 v112 ECD
WPPPGTGDVVVQAPTQVSGFLGDSVTLPCYLQVPNMEVTTMSQLTWVRHGEQGSMAVFHQTLGPTYSESKRLRFVAARLGAELRNASLRMFGLRVEDEGNYTCMFATFPQGSRSVDIWLRVLAKPQNTAEVQKVQLTGEPVPMARCVSTGGRPPAQITWHSDLGGMPNTSQVPGFLSGTVTVTSLWILVPSSQVDGKNVTCKVEHESFEKPQLLTVNLTVYYPPEVSISGYDNNWYLGQNEATLTCDARSNPEPTGYNWSTTMGPLPPFAVAQGAQLLIRPVDKPINTTLICNVTNALGARQAELTVQVKEGPPSEHSGISRN

SEQ ID NO: 268 - protein, 323 aa, synthetic construct
  REGION 1..323: note = CD155 v113 ECD
WPPPGTGDVVVQAPTQVPGFLGDSVTLPCYLQVPNMEVTTMSQLTWVRHGEQGSMAVFHQTLGPTYSGSKRLRFVAARLGAELRNASLRMFGLRVEGSGNYTCTFVTFPQGSRSVDIWLRVLAKPQNTAEVQKVQLTGEPVPMARCVSTGGRPPAQITWHSDLGGMPNTSQVPGFLSGTVTVTSLWILVPSSQVDGKNVTCKVEHESFEKPQLLTVNLTVYYPPEVSISGYDNNWYLGQNEATLTCDARSNPEPTGYNWSTTMGPLPPFAVAQGAQLLIRPVDKPINTTLICNVTNALGARQAELTVQVKEGPPSEHSGISRN

SEQ ID NO: 269 - protein, 323 aa, synthetic construct
  REGION 1..323: note = CD155 v114 ECD
WPPPGTGDVVVQAPTQVPGFLGDSVTLPCYLQVPNMEVTHVSQLQWARHGEEGSMAVFHQTQGPSYSESKRLEFVAARLGAELRNASLRMFGLRVEDEGNYTCEFVTFPQGSRSVDIWLRVLAKPQNTAEVQKVQLTGEPVPMARCVSTGGRPPAQITWHSDLGGMPNTSQVPGFLSGTVTVTSLWILVPSSQVDGKNVTCKVEHESFEKPQLLTVNLTVYYPPEVSISGYDNNWYLGQNEATLTCDARSNPEPTGYNWSTTMGPLPPFAVAQGAQLLIRPVDKPINTTLICNVTNALGARQAELTVQVKEGPPSEHSGISRN

SEQ ID NO: 270 - protein, 323 aa, synthetic construct
  REGION 1..323: note = CD155 v115 ECD
WPPPGTGDVVVQAPTQVPGFLGDSVTLPCYLQVPNMEVTHVSQLQWARHGEEGSMAVFHQTFGPSYSESKRLEFVAARLGAELRNASLRMFGLRVEDEGNYTCEFVTFPQGSRSVDIWLRVLAKPQNTAEVQKVQLTGEPVPMARCVSTGGRPPAQITWHSDLGGMPNTSQVPGFLSGTVTVTSLWILVPSSQVDGKNVTCKVEHESFEKPQLLTVNLTVYYPPEVSISGYDNNWYLGQNEATLTCDARSNPEPTGYNWSTTMGPLPPFAVAQGAQLLIRPVDKPINTTLICNVTNALGARQAELTVQVKEGPPSEHSGISRN

SEQ ID NO: 271 - protein, 323 aa, synthetic construct
  REGION 1..323: note = CD155 v116 ECD
WPPPGTGDVVVQAPTQVFGFLGDSVMLPCYLQVPNMEVTHVSQVTWARHGESGSMAVFHQTKGPSYSESKRLEFVAARPGAELRNASLRMSGLRVEDEGNYTCMFVTFPQDSRSVDIWLRVLAKPQNTAEVQKVQLTGEPVPMARCVSTGGRPPAQITWHSDLGGMPNTSQVPGFLSGTVTVTSLWILVPSSQVDGKNVTCKVEHESFEKPQLLTVNLTVYYPPEVSISGYDNNWYLGQNEATLTCDARSNPEPTGYNWSTTMGPLPPFAVAQGAQLLIRPVDKPINTTLICNVTNALGARQAELTVQVKEGPPSEHSGISRN

SEQ ID NO: 272 - protein, 323 aa, synthetic construct
  REGION 1..323: note = CD155 v117 ECD
WPPPGTGDVVVQAPTQVSGFLGDSVTLPCYLQVPNMEVTHVSQLSWARHGESGSMAVFHQKQGPWYAESKRLEFVAARLGAELRNASLRMSGLRVEDEGNYTCLFVTFPQRSRSVDIWLRVLAKPQNTAEVQKVQLTGEPVPMARCVSTGGRPPAQITWHSDLGGMPNTSQVPGFLSGTVTVTSLWILVPSSQVDGKNVTCKVEHESFEKPQLLTVNLTVYYPPEVSISGYDNNWYLGQNEATLTCDARSNPEPTGYNWSTTMGPLPPFAVAQGAQLLIRPVDKPINTTLICNVTNALGARQAELTVQVKEGPPSEHSGISRN

SEQ ID NO: 273 - protein, 323 aa, synthetic construct
  REGION 1..323: note = CD155 v118 ECD
WPPPGTGDVVVQAPTQVSGFLGDSVTLPCYLQVPNMEVTHVSQLTWARHGESGSMAVFHQTQGPSYSESKRLEFVAARPGAELRNASLRMFGLRVEDEGNYTCMFVMFPQGSRSVDIWLRVLAKPQNTAEVQKVQLTGEPVPMARCVSTGGRPPAQITWHSDLGGMPNTSQVPGFLSGTVTVTSLWILVPSSQVDGKNVTCKVEHESFEKPQLLTVNLTVYYPPEVSISGYDNNWYLGQNEATLTCDARSNPEPTGYNWSTTMGPLPPFAVAQGAQLLIRPVDKPINTTLICNVTNALGARQAELTVQVKEGPPSEHSGISRN

SEQ ID NO: 274 - protein, 323 aa, synthetic construct
  REGION 1..323: note = CD155 v119 ECD
WPPPGTGDVVVQAPTQVSGFLGDSVTLPCYLQVPNMEVTHVSQLTWARHGESGSMAVFHQTQGPWYAESKRLEFVAARLGAELRNASLRVFGLRAEDEGNYTCQFVTFPQRSRSVDIWLRVLAKPQNTAEVQKVQLTGEPVPMARCVSTGGRPPAQITWHSDLGGMPNTSQVPGFLSGTVTVTSLWILVPSSQVDGKNVTCKVEHESFEKPQLLTVNLTVYYPPEVSISGYDNNWYLGQNEATLTCDARSNPEPTGYNWSTTMGPLPPFAVAQGAQLLIRPVDKPINTTLICNVTNALGARQAELTVQVKEGPPSEHSGISRN

SEQ ID NO: 275 - protein, 116 aa, synthetic construct
  REGION 1..116: note = CD155 v23 IgV
PGTGDVVVQAPTQVPGFLGDSVTLPCYLQVPNMEVTHVSQLTWARHGEMGSMAVFHQTQGPSYSESKRLEFVAARLGAELRNASLRMFGLRVEDEGNYTCLFVTFPQGSRSVDIWL

SEQ ID NO: 276 - protein, 116 aa, synthetic construct
  REGION 1..116: note = CD155 v24 IgV
PGTGDVVVQAPTQVPGFLGDSVTLPCYLQVPNMEVTHVSQLQWARHGELGSMAVFHQTQGPSYSESKRLEFVAARLGAELRNASLRMFGLRVEDEGNYTCEFVTFPQRSRSVDIWL

SEQ ID NO: 277 - protein, 116 aa, synthetic construct
  REGION 1..116: note = CD155 v25 IgV
PGTGDVVVQAPTQVPGFLGDSVTLPCYLQVPNMEVTHVGQLTWARHGESGSMAVFHQTQGPSYSESKRLEFVAARLGAELRNASLRMFGLRVEDEGNYTCLFVTFPQGSRSVDIWL

SEQ ID NO: 278 - protein, 116 aa, synthetic construct
  REGION 1..116: note = CD155 v26 IgV
PGTGDVVVQAPTQVPGFLGDSVTLPCYLQVPNMEVTHVSQLTWARHGESGSMAVFHQTFGPSYSESKRLEFVAARLGAELRNASLRMFGLRVEDEGNYTCLFVTFPQGSRSVDIWL

SEQ ID NO: 279 - protein, 119 aa, synthetic construct
  REGION 1..119: note = CD155 v27 IgV
PGTGDVVVQAPTQVPGFLGDSVTLPCYLQVPNMEVTHVSQLTWARHGEQGSMAVFHQTQGPSYSESKRLEFVAARLGAELRNASLRMFGLRVEDEGNYTCLFVTFPQGSRSVDIWLRVL

SEQ ID NO: 280 - protein, 116 aa, synthetic construct
  REGION 1..116: note = CD155 v28 IgV
PGTGDVVVQAPTQVPGFLGDSVTLPCYLQVPNMEVTHVAQLTWARHGESGSMAVFHQTQGPSYSESKRLEFVAARLGAELRNASLRMFGLRVEDEGNYTCQFVTFPQRSRSVDIWL

SEQ ID NO: 281 - protein, 116 aa, synthetic construct
  REGION 1..116: note = CD155 v29 IgV
PGTGDVVVQAPTQVPGFLGDSVTLPCYLQVPNMEVTHVAQLTWARHGEQGSMAVFHQTQGPSYSESKRLEFVAARLGAELRNASLRMFGLRVEDEGNYTCQFVTFPQRSRSVDIWL

SEQ ID NO: 282 - protein, 116 aa, synthetic construct
  REGION 1..116: note = CD155 v30 IgV
PGTGDVVVQAPTQVPGFLGDSVTLPCYLQVPNMEVTHVSQLTWARHGEWGSMAVFHQTQGPSYSESKRLEFVAARLGAELRNASLRMFGLRVEDEGNYTCEFVTFPQGSRSVDIWL

SEQ ID NO: 283 - protein, 116 aa, synthetic construct
  REGION 1..116: note = CD155 v31 IgV
PGTGDVVVQAPTQVPGFLGDSVTLPCYLQVPNMEVTHVCQLTWARHGESGSMAVFHQTQGPSYSESKRLEFVAARLGAELRNASLRMFGLRVEDEGNYTCLFVTFPQGSRSVDIWL

SEQ ID NO: 284 - protein, 116 aa, synthetic construct
  REGION 1..116: note = CD155 v32 IgV
PGTGDVVVQAPTQVPGFLGDSVTLPCYLQVPNMEVTHVSQLTWARHGEWGSMAVFHQTQGPSYSESKRLEFVAARLGAELRNASLRMFGLRVEDEGNYTCLFVTFPQGSRSVDIWL

SEQ ID NO: 285 - protein, 116 aa, synthetic construct
  REGION 1..116: note = CD155 v33 IgV
PGTGDVVVQAPTQVPGFLGDSVTLPCYLQVPNMEVTHVSQLTWARHGEMGSMAVFHQTQGPSYSESKRLEFVAARLGAELRNASLRMFGLRVEDEGNYTCQFVTFPQGSRSVDIWL

SEQ ID NO: 286 - protein, 116 aa, synthetic construct
  REGION 1..116: note = CD155 v34 IgV
PGTGDVVVQAPTQVPGFLGDSVTLPCYLQVPNMEVTHVLQLTWARHGELGSMAVFHQTFGPSYSESKRLEFVAARLGAELRNASLRMFGLRVEDEGNYTCQFVTFPQGSRSVDIWL

SEQ ID NO: 287 - protein, 116 aa, synthetic construct
  REGION 1..116: note = CD155 v35 IgV
PGTGDVVVQAPTQVPGFLGDSVTLPCYLQVPNMEVTHVWQLTWARHGESGSMAVFHQTQGPSYSESKRLEFVAARLGAELRNASLRMFGLRVEDEGNYTCLFVTFPQGSRSVDIWL

SEQ ID NO: 288 - protein, 116 aa, synthetic construct
  REGION 1..116: note = CD155 v36 IgV
PGTGDVVVQAPTQVPGFLGDSVTLPCYLQVPNMEVTHVQQLTWARHGESGSMAVFHQTQGPSYSESKRLEFVAARLGAELRNASLRMFGLRVEDEGNYTCLFVTFPQGSRSVDIWL

SEQ ID NO: 289 - protein, 116 aa, synthetic construct
  REGION 1..116: note = CD155 v37 IgV
PGTGDVVVQAPTQVPGFLGDSVTLPCYLQVPNMEVTHVSQLTWARHGELGSMAVFHQTQGPSYSESKRLEFVAARLGAELRNASLRMFGLRVEDEGNYTCLFVTFPQGSRSVDIWL

SEQ ID NO: 290 - protein, 116 aa, synthetic construct
  REGION 1..116: note = CD155 v38 IgV
PGTGDVVVQAPTQVPGFLGDSVTLPCYLQVPNMEVTHVSQLTWARHGERGSMAVFHQTQGPSYSESKRLEFVAARLGAELRNASLRMFGLRVEDEGNYTCLFVTFPQGSRSVDIWL

SEQ ID NO: 291 - protein, 116 aa, synthetic construct
  REGION 1..116: note = CD155 v39 IgV
PGTGDVVVQAPTQVPGFLGDSVTLPCYLQVPNMEVTHVSQLTWARHGESGSMAVFHQTQGPSYSESKRLEFVAARLGAELRNASLRMFGLRVEDEGNYTCEFVTFPQGSRSVDIWL

SEQ ID NO: 292 - protein, 116 aa, synthetic construct
  REGION 1..116: note = CD155 v40 IgV
PGTGDVVVQAPTQVPGFLGDSVTLPCYLQVPNMEVTHVSQLTWARHGESGSMAVFHQTQGPSYSESKRLEFVAARLGAELRNASLRMFGLRVEDEGNYTCLFVTFPQRSRSVDIWL

SEQ ID NO: 293 - protein, 116 aa, synthetic construct
  REGION 1..116: note = CD155 v41 IgV
PGTGDVVVQAPTQVPGFLGDSVTLPCYLQVPNMEVTHVSQLTWARHGEEGSMAVFHQTQGPSYSESKRLEFVAARLGAELRNASLRMFGLRVEDEGNYTCLFVTFPQGSRSVDIWL

SEQ ID NO: 294 - protein, 116 aa, synthetic construct
  REGION 1..116: note = CD155 v42 IgV
PGTGDVVVQAPTQVPGFLGDSVTLPCYLQVPNMEVTHVSQLTWARHGESGSMAVFHQTYGPSYSESKRLEFVAARLGAELRNASLRMFGLRVEDEGNYTCLFVTFPQGSRSVDIWL

SEQ ID NO: 295 - protein, 116 aa, synthetic construct
  REGION 1..116: note = CD155 v43 IgV
PGTGDVVVQAPTQVPGFLGDSVTLPCYLQVPNMEVTHVSQLQWARHGEMGSMAVFHQTQGPSYSESKRLEFVAARLGAELRNASLRMFGLRVEDEGNYTCEFVTFPQGSRSVDIWL

SEQ ID NO: 296 - protein, 116 aa, synthetic construct
  REGION 1..116: note = CD155 v44 IgV
PGTGDVVVQAPTQVPGFLGDSVTLPCYLQVPNMEVTHVNQLTWARHGESGSMAVFHQTQGPSYSESKRLEFVAARLGAELRNASLRMFGLRVEDEGNYTCQFVTFPQRSRSVDIWL

SEQ ID NO: 297 - protein, 116 aa, synthetic construct
  REGION 1..116: note = CD155 v45 IgV
PGTGDVVVQAPTQVPGFLGDSVTLPCYLQVPNMEVTHVSQLTWARHGEMGSMALFHQTQGPSYSESKRLEFVAARLGAELRNASLRMFGLRVEDEGNYTCLFVTFPQGSRSVDIWL

SEQ ID NO: 298 - protein, 116 aa, synthetic construct
  REGION 1..116: note = CD155 v46 IgV
PGTGDVVVQAPTQVPGFLGDSVTLPCYLQVPNMEVTHVNQLTWARHGEQGSMAVFHQTFGPSYSESKRLEFVAARLGAELRNASLRMFGLRVEDEGNYTCLFVTFPQGSRSVDIWL

SEQ ID NO: 299 - protein, 116 aa, synthetic construct
  REGION 1..116: note = CD155 v47 IgV
PGTGDVVVQAPTQVPGFLGDSVTLPCYLQVPNMEVTHVAQLTWARHGELGSMAVFHQTQGPSYSESKRLEFVAARLGAELRNASLRMFGLRVEDEGNYTCEFVTFPQRSRSVDIWL

SEQ ID NO: 300 - protein, 116 aa, synthetic construct
  REGION 1..116: note = CD155 v48 IgV
PGTGDVVVQAPTQVPGFLGDSVTLPCYLQVPNMEVTHVWQLTWARHGEQGSMALFHQTYGPSYSESKRLEFVAARLGAELRNASLRMFGLRVEDEGNYTCLFVTFPQGSRSVDIWL

SEQ ID NO: 301 - protein, 116 aa, synthetic construct
  REGION 1..116: note = CD155 v49 IgV
PGTGDVVVQAPTQVPGFLGDSVTLPCYLQVPNMEVTHVSQLTWARHGESGSMAVFHQTQGPSYSESKRLEFVAARLGAELRNASLRMFGLRVEDEGNYTCQFVTFPQGSRSVDIWL

SEQ ID NO: 302 - protein, 116 aa, synthetic construct
  REGION 1..116: note = CD155 v50 IgV
PGTGDVVVQAPTQVPGFLGDSVTLPCYLQVPNMEVTHVLQLTWARHGEQGSMAVFHQTQGPSYSESKRLEFVAARLGAELRNASLRMFGLRVEDEGNYTCEFVTFPQGSRSVDIWL

SEQ ID NO: 303 - protein, 116 aa, synthetic construct
  REGION 1..116: note = CD155 v51 IgV
PGTGDVVVQAPTQVPGFLGDSVTLPCYLQVPNMEVTHVCQLTWARHGELGSMAVFHQTQGPSYSESKRLEFVAARLGAELRNASLRMFGLRVEDEGNYTCLFVTFPQGSRSVDIWL

SEQ ID NO: 304 - protein, 116 aa, synthetic construct
  REGION 1..116: note = CD155 v52 IgV
PGTGDVVVQAPTQVPGFLGDSVTLPCYLQVPNMEVTHVWQLTWARHGERGSMAVFHQTYGPSYSESKRLEFVAARLGAELRNASLRMFGLRVEDEGNYTCQFVTFPQGSRSVDIWL

SEQ ID NO: 305 - protein, 116 aa, synthetic construct
  REGION 1..116: note = CD155 v53 IgV
PGTGDVVVQAPTQVPGFLGDSVTLPCYLQVPNMEVTHVSQLQWARHGERGSMAVFHQTQGPSYSESKRLEFVAARLGAELRNASLRMFGLRVEDEGNYTCEFVTFPQGSRSVDIWL

SEQ ID NO: 306 - protein, 116 aa, synthetic construct
  REGION 1..116: note = CD155 v54 IgV
PGTGDVVVQAPTQVPGFLGDSVTLPCYLQVPNMEVTHVSQLTWARHGERGSMAVFHQTFGPSYSESKRLEFVAARLGAELRNASLRMFGLRVEDEGNYTCQFVTFPQRSRSVDIWL

SEQ ID NO: 307 - protein, 116 aa, synthetic construct
  REGION 1..116: note = CD155 v55 IgV
PGTGDVVVQAPTQVPGFLGDSVTLPCYLQVPNMEVTHVSQLQWARHGELGSMALFHQTQGPSYSESKRLEFVAARLGAELRNASLRMFGLRVEDEGNYTCEFVTFPQGSRSVDIWL

SEQ ID NO: 308 - protein, 116 aa, synthetic construct
  REGION 1..116: note = CD155 v56 IgV
PGTGDVVVQAPTQVPGFLGDSVTLPCYLQVPNMEVTHVSQLTWARHGEMGSMAVFHQTYGPSYSESKRLEFVAARLGAELRNASLRMFGLRVEDEGNYTCLFVTFPQGSRSVDIWL

SEQ ID NO: 309 - protein, 116 aa, synthetic construct
  REGION 1..116: note = CD155 v57 IgV
PGTGDVVVQAPTQVPGFLGDSVTLPCYLQVPNMEVTHVSQLTWARHGESGSMAVFHQTFGPSYSESKRLEFVAARLGAELRNASLRMFGLRVEDEGNYTCEFVTFPQRSRSVDIWL

SEQ ID NO: 310 - protein, 116 aa, synthetic construct
  REGION 1..116: note = CD155 v58 IgV
PGTGDVVVQAPTQVPGFLGDSVTLPCYLQVPNMEVTHVSQLQWARHGEQGSMAVFHQTQGPSYSESKRLEFVAARLGAELRNASLRMFGLRVEDEGNYTCLFVTFPQGSRSVDIWL

SEQ ID NO: 311 - protein, 116 aa, synthetic construct
  REGION 1..116: note = CD155 v59 IgV
PGTGDVVVQAPTQVPGFLGDSVTLPCYLQVPNMEVTHVSQLTWARHGELGSMAVFHQTQGPSYSESKRLEFVAARLGAELRNASLRMFGLRVEDEGNYTCEFVTFPQGSRSVDIWL

SEQ ID NO: 312 - protein, 116 aa, synthetic construct
  REGION 1..116: note = CD155 v60 IgV
PGTGDVVVQAPTQVPGFLGDSVTLPCYLQVPNMEVTHVVQLTWARHGEEGSMAVFHQTQGPSYSESKRLEFVAARLGAELRNASLRMFGLRVEDEGNYTCLFVTFPQGSRSVDIWL

SEQ ID NO: 313 - protein, 116 aa, synthetic construct
  REGION 1..116: note = CD155 v61 IgV
PGTGDVVVQAPTQVPGFLGDSVTLPCYLQVPNMEVTHVSQLQWARHGERGSMAVFHQTQGPSYSESKRLEFVAARLGAELRNASLRMFGLRVEDEGNYTCLFVTFPQRSRSVDIWL

SEQ ID NO: 314 - protein, 116 aa, synthetic construct
  REGION 1..116: note = CD155 v62 IgV
PGTGDVVVQAPTQVPGFLGDSVTLPCYLQVPNMEVTHVGQLTWARHGEQGSMAVFHQTQGPSYSESKRLEFVAARLGAELRNASLRMFGLRVEDEGNYTCEFVTFPQRSRSVDIWL

SEQ ID NO: 315 - protein, 116 aa, synthetic construct
  REGION 1..116: note = CD155 v63 IgV
PGTGDVVVQAPTQVPGFLGDSVTLPCYLQVPNMEVTHVNQLTWARHGEEGSMALFHQTQGPSYSESKRLEFVAARLGAELRNASLRMFGLRVEDEGNYTCEFVTFPQGSRSVDIWL

SEQ ID NO: 316 - protein, 116 aa, synthetic construct
  REGION 1..116: note = CD155 v64 IgV
PGTGDVVVQAPTQVPGFLGDSVTLPCYLQVPNMEVTHVCQLTWARHGEMGSMAVFHQTFGPSYSESKRLEFVAARLGAELRNASLRMFGLRVEDEGNYTCLFVTFPQGSRSVDIWL

SEQ ID NO: 317 - protein, 116 aa, synthetic construct
  REGION 1..116: note = CD155 v65 IgV
PGTGDVVVQAPTQVPGFLGDSVTLPCYLQVPNMEVTHVLQLTWARHGESGSMAVFHQTQGPSYSESKRLEFVAARLGAELRNASLRMFGLRVEDEGNYTCLFVTFPQGSRSVDIWL

SEQ ID NO: 318 - protein, 116 aa, synthetic construct
  REGION 1..116: note = CD155 v66 IgV
PGTGDVVVQAPTQVPGFLGDSVTLPCYLQVPNMEVTHVAQLTWARHGESGSMAVFHQTQGPSYSESKRLEFVAARLGAELRNASLRMFGLRVEDEGNYTCLFVTFPQGSRSVDIWL

SEQ ID NO: 319 - protein, 116 aa, synthetic construct
  REGION 1..116: note = CD155 v67 IgV
PGTGDVVVQAPTQVPGFLGDSVTLPCYLQVPNMEVTHVGQLTWARHGELGSMAVFHQTFGPSYSESKRLEFVAARLGAELRNASLRMFGLRVEDEGNYTCQFVTFPQGSRSVDIWL

SEQ ID NO: 320 - protein, 116 aa, synthetic construct
  REGION 1..116: note = CD155 v68 IgV
PGTGDVVVQAPTQVPGFLGDSVTLPCYLQVPNMEVTHVNQLTWARHGESGSMAVFHQTQGPSYSESKRLEFVAARLGAELRNASLRMFGLRVEDEGNYTCLFVTFPQGSRSVDIWL

SEQ ID NO: 321 - protein, 116 aa, synthetic construct
  REGION 1..116: note = CD155 v69 IgV
PGTGDVVVQAPTQVTGFLGDSVTLPCYLQVPNMEVTHVSQLTWARHGESGSMAVFHQTQGPAYVESKRLEFVAARLGAELRNASLRMSGLRVEDEGNYTCLFVTFPQGSRSVDIWL

SEQ ID NO: 322 - protein, 116 aa, synthetic construct
  REGION 1..116: note = CD155 v70 IgV
PGTGDVVVQAPTQVFGFLGDSVTLPCYLQVPNMEVAHVSQLQWARHGESGSMAVFHQRQGPNYLESKRLGFVAAGLGAELRNASLRMFGLRVEDEGNYTCLFVTFPQGSRSVDIWL

SEQ ID NO: 323 - protein, 116 aa, synthetic construct
  REGION 1..116: note = CD155 v71 IgV
PGTGDVVVQAPTQVTGFLGDSVTLPCYLQVPNMEVTHVSQLQWARHGESGSMAVFHQRQGPNYLESKRLEFVAARLGAELRNASLRMFGLRVEDEGNYTCLFVTFPQGSRSVDIWL

SEQ ID NO: 324 - protein, 116 aa, synthetic construct
  REGION 1..116: note = CD155 v72 IgV
PGTGDVVVQAPTQVFGFLGDSVTLPCYLQVPNMEVTHVSQLTWARHGESGSMAVFHQTQGPAYVESKRLEFVAARLGAELRNASLRMSGLRVEDEGNYTCLFVTFPQGSRSVDIWL

SEQ ID NO: 325 - protein, 116 aa, synthetic construct
  REGION 1..116: note = CD155 v73 IgV
PGTGDVVVQAPTQVFGFLGDSVTLPCYLQVPNMEVTHVSQLQWARHGESGSMAVFHQRQGPNYLESKRLEFVAARLGAELRNASLRMSGLRVEDEGNYTCPFVTFPQGSRSVDIWL

SEQ ID NO: 326 - protein, 116 aa, synthetic construct
  REGION 1..116: note = CD155 v74 IgV
PGTGDVVVQAPTQVSGFLGDSVTLPCYLQVPNMEVTHVSQLTWARHGESGSMAVFHQTQGPSYSESKRLEFVAARPGAELRNASLRMFGLRVEDEGNYTCMFVTFPQGSRSVDIWL

SEQ ID NO: 327 - protein, 116 aa, synthetic construct
  REGION 1..116: note = CD155 v75 IgV
PGTGDVVVQAPTQVSGFLGDSVTLPCYLQVPNMEVTHVSQLTWARHGESGSMAVFHQTQGPSYSESKRLEFVAARLGAELRNASLRMFGLRVEDEGNYTCMFVTFPQGSRSVDIWL

SEQ ID NO: 328 - protein, 116 aa, synthetic construct
  REGION 1..116: note = CD155 v76 IgV
PGTGDVVVQAPTQVPGFLGDSVTLPCYLQVPNMEVTHVSQLTWARHGESGSMAVFHQTQGPSYSESKRLEFVAARPGAELRNASLRMFGLRVEDEGNYTCMFVTFPQGSRSVDIWL

SEQ ID NO: 329 - protein, 116 aa, synthetic construct
  REGION 1..116: note = CD155 v77 IgV
PGTGDVVVQAPTQVTGFLGDSVTLPCYLQVPNMEVTHVSQLQWARHGESGSMAVFHQTQGPSYSESKRLEFVAARPGAELRNASLRMFGLRVEDEGNYTCLFVTFPQGSRSVDIWL

SEQ ID NO: 330 - protein, 116 aa, synthetic construct
  REGION 1..116: note = CD155 v78 IgV
PGTGDVVVQAPTQVTGFLGDSVTLPCYLQVPNMEVTHVSQLQWARHGESGSMAVFHQRQGPHYHESKRLEFVAARLGAELRNASLRMFGLRVEDEGNYTCLFVTFPQGSRSVDIWL

SEQ ID NO: 331 - protein, 116 aa, synthetic construct
  REGION 1..116: note = CD155 v79 IgV
PGTGDVVVQAPTQVTGFLGDSVTLPCYLQVPNMEVTHVSQLTWARHGESGSMAVFHQTQGPSYSESKRLEFVAARLGEELRNASLRMFGLRVEDEGNYTCLFVTFPQGSRSVDIWL

SEQ ID NO: 332 - protein, 116 aa, synthetic construct
  REGION 1..116: note = CD155 v80 IgV
PGTGDVVVQAPTQVSGFLGYSVTLPCYLQVPNMPVTHVSQLTWARHGEGGSMAVFHQTMGPSYSESKRLEFVAARLSPELRNASLRMFGLRVEDEYNYTCLFVTFPQGNRSVDIWL

SEQ ID NO: 333 - protein, 116 aa, synthetic construct
  REGION 1..116: note = CD155 v81 IgV
PGTGDVVVQRPTQVPGFLGYSVTLPCYLQVPNMPVTHVPQLTWARHGESGSMAVFHQTYGPSYSESKRLEFVAARLGEELRNASLRMFGLRVEDEGNYTCLFVTFPQGSRSVDIWL

SEQ ID NO: 334 - protein, 116 aa, synthetic construct
  REGION 1..116: note = CD155 v82 IgV
PGTGDVVVQRPTQVPGFLGYSVTLPCYLQVPNMPVTHVSQLTWARHGESGSMAVFHQTQGPSYSESKRLEFVAARLGAELRNASLRMFGLRVEDEYNYTCLFVTFPQGNRSVDIWL

SEQ ID NO: 335 - protein, 116 aa, synthetic construct
  REGION 1..116: note = CD155 v83 IgV
PGTGDVVVQRPTQVPGFLGYSVTLPCYLQVPNMPVTHVSQLTWARHGESGSMAVFHQTMGPSYSESKRLEFVAVRLSPELRNASLRMFGLRVEDEYNYTCLFVTFPQGSRSVDIWL

SEQ ID NO: 336 - protein, 116 aa, synthetic construct
  REGION 1..116: note = CD155 v84 IgV
PGTGDVVVQAPTQVLGFLGDSVTLPCYLQVPNMSVTHVSQLTWARHGESGSMAVFHQTMGPSYSESKRLEFVAARLSPELRNASLRMFGLRVEDEYNYTCLFVTFPQGNRSVDIWL

SEQ ID NO: 337 - protein, 116 aa, synthetic construct
  REGION 1..116: note = CD155 v85 IgV
PGTGDVVVQAPTQVSGFLGDSVTLPCYLQVPNMEVTHVSQLTWARHGESGSMAVFHQTQGPSYSESKRLEFVAARLGAELRNASLRMFGLRVEDEGNYTCTFVTFPQGSRSVDIWL

SEQ ID NO: 338 - protein, 116 aa, synthetic construct
  REGION 1..116: note = CD155 v86 IgV
PGTGDVVVQAPTQVSGFLGDSVTLPCYLQVPNMEVTHVSQLTWARHGESGSMAVFHQTHGPSYSESKRLEFVAARQGAELRNASLRMSGLRVEDEGNYTCLFVTFPQGSRSVDIWL

SEQ ID NO: 339 - protein, 116 aa, synthetic construct
  REGION 1..116: note = CD155 v87 IgV
PGTGDVVVQAPTQVPGFLGDSVTLPCYLQVPNMEVTHVSQLQWARHGEKGSMAVFHQTFGPSYSESKRLEFVAARLGAELRNASLRMFGLRVEDEGNYTCQFVTFPQRSRSVDIWL

SEQ ID NO: 340 - protein, 116 aa, synthetic construct
  REGION 1..116: note = CD155 v88 IgV
PGTGDVVVQAPTQVPGFLGDSVTLPCYLQVPNMEVTHVSQLQWARHGEQGSMAVFHQTYGPSYSESKRLEFVAARLGAELRNASLRMFGLRVEDEGNYTCQFVTFPQRSRSVDIWL

SEQ ID NO: 341 - protein, 116 aa, synthetic construct
  REGION 1..116: note = CD155 v89 IgV
PGTGDVVVQAPTQVPGFLGDSVTLPCYLQVPNMEVTHVSQLQWARHGEQGSMAVFHQTYGPSYSESKRLEFVAARLGAELRNASLRMFGLRVEDEGNYTCEFVTFPQRSRSVDIWL

SEQ ID NO: 342 - protein, 116 aa, synthetic construct
  REGION 1..116: note = CD155 v90 IgV
PGTGDVVVQAPTQVPGFLGDSVTLPCYLQVPNMEVTHVSQLTWARHGESGSMAAFHQMQGPWYAESKRLEFVAARLGAELRNASLRMFGLRVDDEGNYTCTFVTFPQGSRSVDIWL

SEQ ID NO: 343 - protein, 116 aa, synthetic construct
  REGION 1..116: note = CD155 v91 IgV
PGTGDVVVQAPTQVLGFLGDSVTLPCYLQVPNMEVTHVSQLTWARHGESGSMATFHQSQGPYYAESKRLEFVAARLGAELRNASLRMFGLRVEDEGNYTCTFVTFPQGSRSVDIWL

SEQ ID NO: 344 - protein, 116 aa, synthetic construct
  REGION 1..116: note = CD155 v92 IgV
PGTGDVVVQAPTQVTGFLGDSVTLPCYLQVPNMEVTHVSQLQWARHGESGSMAVFHQTQGPSYSESKRLEFVAARLGAELRNASLRMFGLRVEDEGNYTCLFVTFPQGSRSVDIWL

SEQ ID NO: 345 - protein, 116 aa, synthetic construct
  REGION 1..116: note = CD155 v93 IgV
PGTGDVVVQAPTQVLGFLGDSVTLPCYLQVPNMEVTHVSQLTWARHGESGSMAAFHQMQGPWYAESKRLEFVAARLGAELRNASLRMFGLRVEDEGNYTCTFVTFPQGSRSVDIWL

SEQ ID NO: 346 - protein, 116 aa, synthetic construct
  REGION 1..116: note = CD155 v94 IgV
PGTGDVVVQAPTQVPGFLGDSVTLPCYLQVPNMEVTHVSQLTWARHGESGSMAVFHQMQGPWYAESKRLEFVAARLGAELRNASLRMFGLRVEDEGNYTCTFVTFPQGSRSVDIWL

SEQ ID NO: 347 - protein, 116 aa, synthetic construct
  REGION 1..116: note = CD155 v95 IgV
PGTGDVVVQAPTQVSGFLGDSVTLPCYLQVPNMEVTHAGQLGWARHGESGSMAVFHQTQGPSYSESKRLEFVAARLGAELRNASLRMFGLRVEDEGNYTCNFVTFPQGSRSVDIWL

SEQ ID NO: 348 - protein, 116 aa, synthetic construct
  REGION 1..116: note = CD155 v96 IgV
PGTGDVVVQAPTQVHGFLGDSVTLPCYLQVPNMEVTHVGQLIWARHGETRHMALFEQSQGPDYSGSKRLEFVAARLGAELRNASLRMFGLRVEDEGNYTCNFVTFPQGSRSVDIWL

SEQ ID NO: 349 - protein, 116 aa, synthetic construct
  REGION 1..116: note = CD155 v97 IgV
PGTGDVVVQAPTQVSGFLGDSVTLPCYLQVPNMEVTHVGQLVWARHGESGSMAVLHQTQGPSYWESKRLEFVAARLGAELRNASLRMFGLRVEDEGNYTCNFVTFPQGSRSVDIWL

SEQ ID NO: 350 - protein, 116 aa, synthetic construct
  REGION 1..116: note = CD155 v98 IgV
PGTGDVVVQAPTQVSGFLGDSVTLPCYLQVPNMEVTHVSQLIWARHGESGSMAVFHQTQGPSYSESKRLEFVAARLGAELRNASLRMFGLRVEDEGNYTCNFVTFPQGSRSVDIWL

SEQ ID NO: 351 - protein, 116 aa, synthetic construct
  REGION 1..116: note = CD155 v99 IgV
PGTGDVVVQAPTQVSGFLGDSVTLPCYLQVPNMEVTHVGQLGWARHGESGSMAVFHQTQGPSYSESKRLEFVAARLGAELRNASLRMFGLRVEDEGNYTCNFATFPQGSRSVDIWL

SEQ ID NO: 352 - protein, 116 aa, synthetic construct
  REGION 1..116: note = CD155 v100 IgV
PGTGDVVVQAPTQVHGFLGDSVTLPCYLQVPNMEVTRVGQLIWARHGETRHMALFEQSQGPDYSGSKRLEFVAARLGAELRNASLRMFGLRVEDEGNYTCYFLTHPQGSRSVDIWL

SEQ ID NO: 353 - protein, 116 aa, synthetic construct
  REGION 1..116: note = CD155 v101 IgV
PGTGDVVVQAPTQVPGFLGDSVTLPCYLQVPNMVVTHVGQLGWARHGESGSMAVFHQTQGPSYSESKRLEFVAARLGAELRNASLRMFGLRVEDEGNYTCNFVTFPQGSRSVDIWL

SEQ ID NO: 354 - protein, 116 aa, synthetic construct
  REGION 1..116: note = CD155 v102 IgV
PGTGDVVVQAPTQVSGFLGDSVTLPCYLQVPNMEVTHVSQLQWARHGESGSMAVFHQTQGPSYSESKRLEFVAARPGAELRNASLRMFGLRVEDEGNYTCTFVTFPQGSRSVDIWL

SEQ ID NO: 355 - protein, 116 aa, synthetic construct
  REGION 1..116: note = CD155 v103 IgV
PGTGDVVVQAPTQVLGFLGDSVTLPCYLQVPNMEVTHVSQLTWARHGESGSMAVFHQTRGPSYSESKRLEFVAARLGAELRNASLRMFGLRVEDEGNYTCLFVTFPQGSRSVDIWL

SEQ ID NO: 356 - protein, 116 aa, synthetic construct
  REGION 1..116: note = CD155 v104 IgV
PGTGDVVVQRPTQVPGFLGYSVTLPCYLQVPNMPVTHVLQLTWARHGEGGSMAVFHQTYGPSYSESKRLEFVAARLGEELRNASLRMFGLRVEDEGNYTCLFVTFPQGSRSVDIWL

SEQ ID NO: 357 - protein, 116 aa, synthetic construct
  REGION 1..116: note = CD155 v105 IgV
PGTGDVVVQAPTQVLGFLGDSVTLPCYLQVPNMEVTHVSQLTWARRGESGSMAVFHQTQGPSYSESKRLEFVAARLGAELRNASLRMFGLRVEDEGNYTCTFVTFPQGSRSVNIWL

SEQ ID NO: 358 - protein, 116 aa, synthetic construct
  REGION 1..116: note = CD155 v106 IgV
PGTGDVVVQRPTQVPGFLGYSVTLPCYLQVPNMPVTHVSQLTWARHGESGSMAVFHQTMGPSYSESKRLEFVAARLSPELRNASLRMFGLRVEDEGNYTCTFVTFPQGSRSVDIWL

SEQ ID NO: 359 - protein, 116 aa, synthetic construct
  REGION 1..116: note = CD155 v107 IgV
PGTGDVVVQAPTQVPGFLGDSVTLPCYLQVPNMEVTHVSQLTWARHGESGSMAVFHQTQGPTYSESKRLEFVAARLGAELRNASLRMFGLRVEDEGNYTCTFVTFPQGSRSVDIWL

SEQ ID NO: 360 - protein, 116 aa, synthetic construct
  REGION 1..116: note = CD155 v108 IgV
PGTGDVVVQRPTQVPGFLGYSVTLPCYLQVPNMPVTHVSQLTWARHGEGGSMAAFHQTMGPSYSESERLEFVAARLGAELRNASLRMFGLRVEDEGNYTCTFVTFPQGSRSVDIWL

SEQ ID NO: 361 - protein, 116 aa, synthetic construct
  REGION 1..116: note = CD155 v109 IgV
PGTGDVVVQAPTQVLGFLGDSVTLPCYLQVPNMEVTHVSQLTWVRHGESGSMAVFHQTYGPSYSESKRLDFVAARLGAELRNASLRMFGLRVEDEGNYTCTFVTFPQGSRSVDIWL

SEQ ID NO: 362 - protein, 116 aa, synthetic construct
  REGION 1..116: note = CD155 v110 IgV
PGTGDVVVQAPTQVPGFLGDSVTLPCYLQVPNMEVTTMSQLTWVRHGEQGSMAVFHQTLGPTYSESKRLRFVAARLGAELRNASLRMFGLRVEGSGNYTCTFVTFPQGSRSVNIWL

SEQ ID NO: 363 - protein, 116 aa, synthetic construct
  REGION 1..116: note = CD155 v111 IgV
PGTGDVVVQAPTQVLGFLGDSVTLPCYLQVPNMEVTHVPQLQWARHGESGSMAVFHQGQGPHYEESKRLEFVAARLGAELRNASLRMFGLRVEDEGNYTCTFVTFPQGSRSVNIWL

SEQ ID NO: 364 - protein, 116 aa, synthetic construct
  REGION 1..116: note = CD155 v112 IgV
PGTGDVVVQAPTQVSGFLGDSVTLPCYLQVPNMEVTTMSQLTWVRHGEQGSMAVFHQTLGPTYSESKRLRFVAARLGAELRNASLRMFGLRVEDEGNYTCMFATFPQGSRSVDIWL

SEQ ID NO: 365 - protein, 116 aa, synthetic construct
  REGION 1..116: note = CD155 v113 IgV
PGTGDVVVQAPTQVPGFLGDSVTLPCYLQVPNMEVTTMSQLTWVRHGEQGSMAVFHQTLGPTYSGSKRLRFVAARLGAELRNASLRMFGLRVEGSGNYTCTFVTFPQGSRSVDIWL

SEQ ID NO: 366 - protein, 116 aa, synthetic construct
  REGION 1..116: note = CD155 v114 IgV
PGTGDVVVQAPTQVPGFLGDSVTLPCYLQVPNMEVTHVSQLQWARHGEEGSMAVFHQTQGPSYSESKRLEFVAARLGAELRNASLRMFGLRVEDEGNYTCEFVTFPQGSRSVDIWL

SEQ ID NO: 367 - protein, 116 aa, synthetic construct
  REGION 1..116: note = CD155 v115 IgV
PGTGDVVVQAPTQVPGFLGDSVTLPCYLQVPNMEVTHVSQLQWARHGEEGSMAVFHQTFGPSYSESKRLEFVAARLGAELRNASLRMFGLRVEDEGNYTCEFVTFPQGSRSVDIWL

SEQ ID NO: 368 - protein, 116 aa, synthetic construct
  REGION 1..116: note = CD155 v116 IgV
PGTGDVVVQAPTQVFGFLGDSVMLPCYLQVPNMEVTHVSQVTWARHGESGSMAVFHQTKGPSYSESKRLEFVAARPGAELRNASLRMSGLRVEDEGNYTCMFVTFPQDSRSVDIWL

SEQ ID NO: 369 - protein, 116 aa, synthetic construct
  REGION 1..116: note = CD155 v117 IgV
PGTGDVVVQAPTQVSGFLGDSVTLPCYLQVPNMEVTHVSQLSWARHGESGSMAVFHQKQGPWYAESKRLEFVAARLGAELRNASLRMSGLRVEDEGNYTCLFVTFPQRSRSVDIWL

SEQ ID NO: 370 - protein, 116 aa, synthetic construct
  REGION 1..116: note = CD155 v118 IgV
PGTGDVVVQAPTQVSGFLGDSVTLPCYLQVPNMEVTHVSQLTWARHGESGSMAVFHQTQGPSYSESKRLEFVAARPGAELRNASLRMFGLRVEDEGNYTCMFVMFPQGSRSVDIWL

SEQ ID NO: 371 - protein, 116 aa, synthetic construct
  REGION 1..116: note = CD155 v119 IgV
PGTGDVVVQAPTQVSGFLGDSVTLPCYLQVPNMEVTHVSQLTWARHGESGSMAVFHQTQGPWYAESKRLEFVAARLGAELRNASLRVFGLRAEDEGNYTCQFVTFPQRSRSVDIWL

SEQ ID NO: 372 - protein, 122 aa, synthetic construct
  REGION 1..122: note = CD155 v23 IgV
WPPPGTGDVVVQAPTQVPGFLGDSVTLPCYLQVPNMEVTHVSQLTWARHGEMGSMAVFHQTQGPSYSESKRLEFVAARLGAELRNASLRMFGLRVEDEGNYTCLFVTFPQGSRSVDIWLRVL

SEQ ID NO: 373 - protein, 122 aa, synthetic construct
  REGION 1..122: note = CD155 v24 IgV
WPPPGTGDVVVQAPTQVPGFLGDSVTLPCYLQVPNMEVTHVSQLQWARHGELGSMAVFHQTQGPSYSESKRLEFVAARLGAELRNASLRMFGLRVEDEGNYTCEFVTFPQRSRSVDIWLRVL

SEQ ID NO: 374 - protein, 122 aa, synthetic construct
  REGION 1..122: note = CD155 v25 IgV
WPPPGTGDVVVQAPTQVPGFLGDSVTLPCYLQVPNMEVTHVGQLTWARHGESGSMAVFHQTQGPSYSESKRLEFVAARLGAELRNASLRMFGLRVEDEGNYTCLFVTFPQGSRSVDIWLRVL

SEQ ID NO: 375 - protein, 122 aa, synthetic construct
  REGION 1..122: note = CD155 v26 IgV
WPPPGTGDVVVQAPTQVPGFLGDSVTLPCYLQVPNMEVTHVSQLTWARHGESGSMAVFHQTFGPSYSESKRLEFVAARLGAELRNASLRMFGLRVEDEGNYTCLFVTFPQGSRSVDIWLRVL

SEQ ID NO: 376 - protein, 122 aa, synthetic construct
  REGION 1..122: note = CD155 v27 IgV
WPPPGTGDVVVQAPTQVPGFLGDSVTLPCYLQVPNMEVTHVSQLTWARHGEQGSMAVFHQTQGPSYSESKRLEFVAARLGAELRNASLRMFGLRVEDEGNYTCLFVTFPQGSRSVDIWLRVL

SEQ ID NO: 377 - protein, 122 aa, synthetic construct
  REGION 1..122: note = CD155 v28 IgV
WPPPGTGDVVVQAPTQVPGFLGDSVTLPCYLQVPNMEVTHVAQLTWARHGESGSMAVFHQTQGPSYSESKRLEFVAARLGAELRNASLRMFGLRVEDEGNYTCQFVTFPQRSRSVDIWLRVL

SEQ ID NO: 378 - protein, 122 aa, synthetic construct
  REGION 1..122: note = CD155 v29 IgV
WPPPGTGDVVVQAPTQVPGFLGDSVTLPCYLQVPNMEVTHVAQLTWARHGEQGSMAVFHQTQGPSYSESKRLEFVAARLGAELRNASLRMFGLRVEDEGNYTCQFVTFPQRSRSVDIWLRVL

SEQ ID NO: 379 - protein, 122 aa, synthetic construct
  REGION 1..122: note = CD155 v30 IgV
WPPPGTGDVVVQAPTQVPGFLGDSVTLPCYLQVPNMEVTHVSQLTWARHGEWGSMAVFHQTQGPSYSESKRLEFVAARLGAELRNASLRMFGLRVEDEGNYTCEFVTFPQGSRSVDIWLRVL

SEQ ID NO: 380 - protein, 122 aa, synthetic construct
  REGION 1..122: note = CD155 v31 IgV
WPPPGTGDVVVQAPTQVPGFLGDSVTLPCYLQVPNMEVTHVCQLTWARHGESGSMAVFHQTQGPSYSESKRLEFVAARLGAELRNASLRMFGLRVEDEGNYTCLFVTFPQGSRSVDIWLRVL

SEQ ID NO: 381 - protein, 122 aa, synthetic construct
  REGION 1..122: note = CD155 v32 IgV
WPPPGTGDVVVQAPTQVPGFLGDSVTLPCYLQVPNMEVTHVSQLTWARHGEWGSMAVFHQTQGPSYSESKRLEFVAARLGAELRNASLRMFGLRVEDEGNYTCLFVTFPQGSRSVDIWLRVL

SEQ ID NO: 382 - protein, 122 aa, synthetic construct
  REGION 1..122: note = CD155 v33 IgV
WPPPGTGDVVVQAPTQVPGFLGDSVTLPCYLQVPNMEVTHVSQLTWARHGEMGSMAVFHQTQGPSYSESKRLEFVAARLGAELRNASLRMFGLRVEDEGNYTCQFVTFPQGSRSVDIWLRVL

SEQ ID NO: 383 - protein, 122 aa, synthetic construct
  REGION 1..122: note = CD155 v34 IgV
WPPPGTGDVVVQAPTQVPGFLGDSVTLPCYLQVPNMEVTHVLQLTWARHGELGSMAVFHQTFGPSYSESKRLEFVAARLGAELRNASLRMFGLRVEDEGNYTCQFVTFPQGSRSVDIWLRVL

SEQ ID NO: 384 - protein, 122 aa, synthetic construct
  REGION 1..122: note = CD155 v35 IgV
WPPPGTGDVVVQAPTQVPGFLGDSVTLPCYLQVPNMEVTHVWQLTWARHGESGSMAVFHQTQGPSYSESKRLEFVAARLGAELRNASLRMFGLRVEDEGNYTCLFVTFPQGSRSVDIWLRVL

SEQ ID NO: 385 - protein, 122 aa, synthetic construct
  REGION 1..122: note = CD155 v36 IgV
WPPPGTGDVVVQAPTQVPGFLGDSVTLPCYLQVPNMEVTHVQQLTWARHGESGSMAVFHQTQGPSYSESKRLEFVAARLGAELRNASLRMFGLRVEDEGNYTCLFVTFPQGSRSVDIWLRVL

SEQ ID NO: 386 - protein, 122 aa, synthetic construct
  REGION 1..122: note = CD155 v37 IgV
WPPPGTGDVVVQAPTQVPGFLGDSVTLPCYLQVPNMEVTHVSQLTWARHGELGSMAVFHQTQGPSYSESKRLEFVAARLGAELRNASLRMFGLRVEDEGNYTCLFVTFPQGSRSVDIWLRVL

SEQ ID NO: 387 - protein, 122 aa, synthetic construct
  REGION 1..122: note = CD155 v38 IgV
WPPPGTGDVVVQAPTQVPGFLGDSVTLPCYLQVPNMEVTHVSQLTWARHGERGSMAVFHQTQGPSYSESKRLEFVAARLGAELRNASLRMFGLRVEDEGNYTCLFVTFPQGSRSVDIWLRVL

SEQ ID NO: 388 - protein, 122 aa, synthetic construct
  REGION 1..122: note = CD155 v39 IgV
WPPPGTGDVVVQAPTQVPGFLGDSVTLPCYLQVPNMEVTHVSQLTWARHGESGSMAVFHQTQGPSYSESKRLEFVAARLGAELRNASLRMFGLRVEDEGNYTCEFVTFPQGSRSVDIWLRVL

SEQ ID NO: 389 - protein, 122 aa, synthetic construct
  REGION 1..122: note = CD155 v40 IgV
WPPPGTGDVVVQAPTQVPGFLGDSVTLPCYLQVPNMEVTHVSQLTWARHGESGSMAVFHQTQGPSYSESKRLEFVAARLGAELRNASLRMFGLRVEDEGNYTCLFVTFPQRSRSVDIWLRVL

SEQ ID NO: 390 - protein, 122 aa, synthetic construct
  REGION 1..122: note = CD155 v41 IgV
WPPPGTGDVVVQAPTQVPGFLGDSVTLPCYLQVPNMEVTHVSQLTWARHGEEGSMAVFHQTQGPSYSESKRLEFVAARLGAELRNASLRMFGLRVEDEGNYTCLFVTFPQGSRSVDIWLRVL

SEQ ID NO: 391 - protein, 122 aa, synthetic construct
  REGION 1..122: note = CD155 v42 IgV
WPPPGTGDVVVQAPTQVPGFLGDSVTLPCYLQVPNMEVTHVSQLTWARHGESGSMAVFHQTYGPSYSESKRLEFVAARLGAELRNASLRMFGLRVEDEGNYTCLFVTFPQGSRSVDIWLRVL

SEQ ID NO: 392 - protein, 122 aa, synthetic construct
  REGION 1..122: note = CD155 v43 IgV
WPPPGTGDVVVQAPTQVPGFLGDSVTLPCYLQVPNMEVTHVSQLQWARHGEMGSMAVFHQTQGPSYSESKRLEFVAARLGAELRNASLRMFGLRVEDEGNYTCEFVTFPQGSRSVDIWLRVL

SEQ ID NO: 393 - protein, 122 aa, synthetic construct
  REGION 1..122: note = CD155 v44 IgV
WPPPGTGDVVVQAPTQVPGFLGDSVTLPCYLQVPNMEVTHVNQLTWARHGESGSMAVFHQTQGPSYSESKRLEFVAARLGAELRNASLRMFGLRVEDEGNYTCQFVTFPQRSRSVDIWLRVL

SEQ ID NO: 394 - protein, 122 aa, synthetic construct
  REGION 1..122: note = CD155 v45 IgV
WPPPGTGDVVVQAPTQVPGFLGDSVTLPCYLQVPNMEVTHVSQLTWARHGEMGSMALFHQTQGPSYSESKRLEFVAARLGAELRNASLRMFGLRVEDEGNYTCLFVTFPQGSRSVDIWLRVL

SEQ ID NO: 395 - protein, 122 aa, synthetic construct
  REGION 1..122: note = CD155 v46 IgV
WPPPGTGDVVVQAPTQVPGFLGDSVTLPCYLQVPNMEVTHVNQLTWARHGEQGSMAVFHQTFGPSYSESKRLEFVAARLGAELRNASLRMFGLRVEDEGNYTCLFVTFPQGSRSVDIWLRVL

SEQ ID NO: 396 - protein, 122 aa, synthetic construct
  REGION 1..122: note = CD155 v47 IgV
WPPPGTGDVVVQAPTQVPGFLGDSVTLPCYLQVPNMEVTHVAQLTWARHGELGSMAVFHQTQGPSYSESKRLEFVAARLGAELRNASLRMFGLRVEDEGNYTCEFVTFPQRSRSVDIWLRVL

SEQ ID NO: 397 - protein, 122 aa, synthetic construct
  REGION 1..122: note = CD155 v48 IgV
WPPPGTGDVVVQAPTQVPGFLGDSVTLPCYLQVPNMEVTHVWQLTWARHGEQGSMALFHQTYGPSYSESKRLEFVAARLGAELRNASLRMFGLRVEDEGNYTCLFVTFPQGSRSVDIWLRVL

SEQ ID NO: 398 - protein, 122 aa, synthetic construct
  REGION 1..122: note = CD155 v49 IgV
WPPPGTGDVVVQAPTQVPGFLGDSVTLPCYLQVPNMEVTHVSQLTWARHGESGSMAVFHQTQGPSYSESKRLEFVAARLGAELRNASLRMFGLRVEDEGNYTCQFVTFPQGSRSVDIWLRVL

SEQ ID NO: 399 - protein, 122 aa, synthetic construct
  REGION 1..122: note = CD155 v50 IgV
WPPPGTGDVVVQAPTQVPGFLGDSVTLPCYLQVPNMEVTHVLQLTWARHGEQGSMAVFHQTQGPSYSESKRLEFVAARLGAELRNASLRMFGLRVEDEGNYTCEFVTFPQGSRSVDIWLRVL

SEQ ID NO: 400 - protein, 122 aa, synthetic construct
  REGION 1..122: note = CD155 v51 IgV
WPPPGTGDVVVQAPTQVPGFLGDSVTLPCYLQVPNMEVTHVCQLTWARHGELGSMAVFHQTQGPSYSESKRLEFVAARLGAELRNASLRMFGLRVEDEGNYTCLFVTFPQGSRSVDIWLRVL

SEQ ID NO: 401 - protein, 122 aa, synthetic construct
  REGION 1..122: note = CD155 v52 IgV
WPPPGTGDVVVQAPTQVPGFLGDSVTLPCYLQVPNMEVTHVWQLTWARHGERGSMAVFHQTYGPSYSESKRLEFVAARLGAELRNASLRMFGLRVEDEGNYTCQFVTFPQGSRSVDIWLRVL

SEQ ID NO: 402 - protein, 122 aa, synthetic construct
  REGION 1..122: note = CD155 v53 IgV
WPPPGTGDVVVQAPTQVPGFLGDSVTLPCYLQVPNMEVTHVSQLQWARHGERGSMAVFHQTQGPSYSESKRLEFVAARLGAELRNASLRMFGLRVEDEGNYTCEFVTFPQGSRSVDIWLRVL

SEQ ID NO: 403 - protein, 122 aa, synthetic construct
  REGION 1..122: note = CD155 v54 IgV
WPPPGTGDVVVQAPTQVPGFLGDSVTLPCYLQVPNMEVTHVSQLTWARHGERGSMAVFHQTFGPSYSESKRLEFVAARLGAELRNASLRMFGLRVEDEGNYTCQFVTFPQRSRSVDIWLRVL

SEQ ID NO: 404 - protein, 122 aa, synthetic construct
  REGION 1..122: note = CD155 v55 IgV
WPPPGTGDVVVQAPTQVPGFLGDSVTLPCYLQVPNMEVTHVSQLQWARHGELGSMALFHQTQGPSYSESKRLEFVAARLGAELRNASLRMFGLRVEDEGNYTCEFVTFPQGSRSVDIWLRVL

SEQ ID NO: 405 - protein, 122 aa, synthetic construct
  REGION 1..122: note = CD155 v56 IgV
WPPPGTGDVVVQAPTQVPGFLGDSVTLPCYLQVPNMEVTHVSQLTWARHGEMGSMAVFHQTYGPSYSESKRLEFVAARLGAELRNASLRMFGLRVEDEGNYTCLFVTFPQGSRSVDIWLRVL

SEQ ID NO: 406 - protein, 122 aa, synthetic construct
  REGION 1..122: note = CD155 v57 IgV
WPPPGTGDVVVQAPTQVPGFLGDSVTLPCYLQVPNMEVTHVSQLTWARHGESGSMAVFHQTFGPSYSESKRLEFVAARLGAELRNASLRMFGLRVEDEGNYTCEFVTFPQRSRSVDIWLRVL

SEQ ID NO: 407 - protein, 122 aa, synthetic construct
  REGION 1..122: note = CD155 v58 IgV
WPPPGTGDVVVQAPTQVPGFLGDSVTLPCYLQVPNMEVTHVSQLQWARHGEQGSMAVFHQTQGPSYSESKRLEFVAARLGAELRNASLRMFGLRVEDEGNYTCLFVTFPQGSRSVDIWLRVL

SEQ ID NO: 408 - protein, 122 aa, synthetic construct
  REGION 1..122: note = CD155 v59 IgV
WPPPGTGDVVVQAPTQVPGFLGDSVTLPCYLQVPNMEVTHVSQLTWARHGELGSMAVFHQTQGPSYSESKRLEFVAARLGAELRNASLRMFGLRVEDEGNYTCEFVTFPQGSRSVDIWLRVL

SEQ ID NO: 409 - protein, 122 aa, synthetic construct
  REGION 1..122: note = CD155 v60 IgV
WPPPGTGDVVVQAPTQVPGFLGDSVTLPCYLQVPNMEVTHVVQLTWARHGEEGSMAVFHQTQGPSYSESKRLEFVAARLGAELRNASLRMFGLRVEDEGNYTCLFVTFPQGSRSVDIWLRVL

SEQ ID NO: 410 - protein, 122 aa, synthetic construct
  REGION 1..122: note = CD155 v61 IgV
WPPPGTGDVVVQAPTQVPGFLGDSVTLPCYLQVPNMEVTHVSQLQWARHGERGSMAVFHQTQGPSYSESKRLEFVAARLGAELRNASLRMFGLRVEDEGNYTCLFVTFPQRSRSVDIWLRVL

SEQ ID NO: 411 - protein, 122 aa, synthetic construct
  REGION 1..122: note = CD155 v62 IgV
WPPPGTGDVVVQAPTQVPGFLGDSVTLPCYLQVPNMEVTHVGQLTWARHGEQGSMAVFHQTQGPSYSESKRLEFVAARLGAELRNASLRMFGLRVEDEGNYTCEFVTFPQRSRSVDIWLRVL

SEQ ID NO: 412 - protein, 122 aa, synthetic construct
  REGION 1..122: note = CD155 v63 IgV
WPPPGTGDVVVQAPTQVPGFLGDSVTLPCYLQVPNMEVTHVNQLTWARHGEEGSMALFHQTQGPSYSESKRLEFVAARLGAELRNASLRMFGLRVEDEGNYTCEFVTFPQGSRSVDIWLRVL

SEQ ID NO: 413 - protein, 122 aa, synthetic construct
  REGION 1..122: note = CD155 v64 IgV
WPPPGTGDVVVQAPTQVPGFLGDSVTLPCYLQVPNMEVTHVCQLTWARHGEMGSMAVFHQTFGPSYSESKRLEFVAARLGAELRNASLRMFGLRVEDEGNYTCLFVTFPQGSRSVDIWLRVL

SEQ ID NO: 414 - protein, 122 aa, synthetic construct
  REGION 1..122: note = CD155 v65 IgV
WPPPGTGDVVVQAPTQVPGFLGDSVTLPCYLQVPNMEVTHVLQLTWARHGESGSMAVFHQTQGPSYSESKRLEFVAARLGAELRNASLRMFGLRVEDEGNYTCLFVTFPQGSRSVDIWLRVL

SEQ ID NO: 415 - protein, 122 aa, synthetic construct
  REGION 1..122: note = CD155 v66 IgV
WPPPGTGDVVVQAPTQVPGFLGDSVTLPCYLQVPNMEVTHVAQLTWARHGESGSMAVFHQTQGPSYSESKRLEFVAARLGAELRNASLRMFGLRVEDEGNYTCLFVTFPQGSRSVDIWLRVL

SEQ ID NO: 416 - protein, 122 aa, synthetic construct
  REGION 1..122: note = CD155 v67 IgV
WPPPGTGDVVVQAPTQVPGFLGDSVTLPCYLQVPNMEVTHVGQLTWARHGELGSMAVFHQTFGPSYSESKRLEFVAARLGAELRNASLRMFGLRVEDEGNYTCQFVTFPQGSRSVDIWLRVL

SEQ ID NO: 417 - protein, 122 aa, synthetic construct
  REGION 1..122: note = CD155 v68 IgV
WPPPGTGDVVVQAPTQVPGFLGDSVTLPCYLQVPNMEVTHVNQLTWARHGESGSMAVFHQTQGPSYSESKRLEFVAARLGAELRNASLRMFGLRVEDEGNYTCLFVTFPQGSRSVDIWLRVL

SEQ ID NO: 418 - protein, 122 aa, synthetic construct
  REGION 1..122: note = CD155 v69 IgV
WPPPGTGDVVVQAPTQVTGFLGDSVTLPCYLQVPNMEVTHVSQLTWARHGESGSMAVFHQTQGPAYVESKRLEFVAARLGAELRNASLRMSGLRVEDEGNYTCLFVTFPQGSRSVDIWLRVL

SEQ ID NO: 419 - protein, 122 aa, synthetic construct
  REGION 1..122: note = CD155 v70 IgV
WPPPGTGDVVVQAPTQVFGFLGDSVTLPCYLQVPNMEVAHVSQLQWARHGESGSMAVFHQRQGPNYLESKRLGFVAAGLGAELRNASLRMFGLRVEDEGNYTCLFVTFPQGSRSVDIWLRVL

SEQ ID NO: 420 - protein, 122 aa, synthetic construct
  REGION 1..122: note = CD155 v71 IgV
WPPPGTGDVVVQAPTQVTGFLGDSVTLPCYLQVPNMEVTHVSQLQWARHGESGSMAVFHQRQGPNYLESKRLEFVAARLGAELRNASLRMFGLRVEDEGNYTCLFVTFPQGSRSVDIWLRVL

SEQ ID NO: 421 - protein, 122 aa, synthetic construct
  REGION 1..122: note = CD155 v72 IgV
WPPPGTGDVVVQAPTQVFGFLGDSVTLPCYLQVPNMEVTHVSQLTWARHGESGSMAVFHQTQGPAYVESKRLEFVAARLGAELRNASLRMSGLRVEDEGNYTCLFVTFPQGSRSVDIWLRVL

SEQ ID NO: 422 - protein, 122 aa, synthetic construct
  REGION 1..122: note = CD155 v73 IgV
WPPPGTGDVVVQAPTQVFGFLGDSVTLPCYLQVPNMEVTHVSQLQWARHGESGSMAVFHQRQGPNYLESKRLEFVAARLGAELRNASLRMSGLRVEDEGNYTCPFVTFPQGSRSVDIWLRVL

SEQ ID NO: 423 - protein, 122 aa, synthetic construct
  REGION 1..122: note = CD155 v74 IgV
WPPPGTGDVVVQAPTQVSGFLGDSVTLPCYLQVPNMEVTHVSQLTWARHGESGSMAVFHQTQGPSYSESKRLEFVAARPGAELRNASLRMFGLRVEDEGNYTCMFVTFPQGSRSVDIWLRVL

SEQ ID NO: 424 - protein, 122 aa, synthetic construct
  REGION 1..122: note = CD155 v75 IgV
WPPPGTGDVVVQAPTQVSGFLGDSVTLPCYLQVPNMEVTHVSQLTWARHGESGSMAVFHQTQGPSYSESKRLEFVAARLGAELRNASLRMFGLRVEDEGNYTCMFVTFPQGSRSVDIWLRVL

SEQ ID NO: 425 - protein, 122 aa, synthetic construct
  REGION 1..122: note = CD155 v76 IgV
WPPPGTGDVVVQAPTQVPGFLGDSVTLPCYLQVPNMEVTHVSQLTWARHGESGSMAVFHQTQGPSYSESKRLEFVAARPGAELRNASLRMFGLRVEDEGNYTCMFVTFPQGSRSVDIWLRVL

SEQ ID NO: 426 - protein, 122 aa, synthetic construct
  REGION 1..122: note = CD155 v77 IgV
WPPPGTGDVVVQAPTQVTGFLGDSVTLPCYLQVPNMEVTHVSQLQWARHGESGSMAVFHQTQGPSYSESKRLEFVAARPGAELRNASLRMFGLRVEDEGNYTCLFVTFPQGSRSVDIWLRVL

SEQ ID NO: 427 - protein, 122 aa, synthetic construct
  REGION 1..122: note = CD155 v78 IgV
WPPPGTGDVVVQAPTQVTGFLGDSVTLPCYLQVPNMEVTHVSQLQWARHGESGSMAVFHQRQGPHYHESKRLEFVAARLGAELRNASLRMFGLRVEDEGNYTCLFVTFPQGSRSVDIWLRVL

SEQ ID NO: 428 - protein, 122 aa, synthetic construct
  REGION 1..122: note = CD155 v79 IgV
WPPPGTGDVVVQAPTQVTGFLGDSVTLPCYLQVPNMEVTHVSQLTWARHGESGSMAVFHQTQGPSYSESKRLEFVAARLGEELRNASLRMFGLRVEDEGNYTCLFVTFPQGSRSVDIWLRVL

SEQ ID NO: 429 - protein, 122 aa, synthetic construct
  REGION 1..122: note = CD155 v80 IgV
WPPPGTGDVVVQAPTQVSGFLGYSVTLPCYLQVPNMPVTHVSQLTWARHGEGGSMAVFHQTMGPSYSESKRLEFVAARLSPELRNASLRMFGLRVEDEYNYTCLFVTFPQGNRSVDIWLRVL

SEQ ID NO: 430 - protein, 122 aa, synthetic construct
  REGION 1..122: note = CD155 v81 IgV
WPPPGTGDVVVQRPTQVPGFLGYSVTLPCYLQVPNMPVTHVPQLTWARHGESGSMAVFHQTYGPSYSESKRLEFVAARLGEELRNASLRMFGLRVEDEGNYTCLFVTFPQGSRSVDIWLRVL

SEQ ID NO: 431 - protein, 122 aa, synthetic construct
  REGION 1..122: note = CD155 v82 IgV
WPPPGTGDVVVQRPTQVPGFLGYSVTLPCYLQVPNMPVTHVSQLTWARHGESGSMAVFHQTQGPSYSESKRLEFVAARLGAELRNASLRMFGLRVEDEYNYTCLFVTFPQGNRSVDIWLRVL

SEQ ID NO: 432 - protein, 122 aa, synthetic construct
  REGION 1..122: note = CD155 v83 IgV
WPPPGTGDVVVQRPTQVPGFLGYSVTLPCYLQVPNMPVTHVSQLTWARHGESGSMAVFHQTMGPSYSESKRLEFVAVRLSPELRNASLRMFGLRVEDEYNYTCLFVTFPQGSRSVDIWLRVL

SEQ ID NO: 433 - protein, 122 aa, synthetic construct
  REGION 1..122: note = CD155 v84 IgV
WPPPGTGDVVVQAPTQVLGFLGDSVTLPCYLQVPNMSVTHVSQLTWARHGESGSMAVFHQTMGPSYSESKRLEFVAARLSPELRNASLRMFGLRVEDEYNYTCLFVTFPQGNRSVDIWLRVL

SEQ ID NO: 434 - protein, 122 aa, synthetic construct
  REGION 1..122: note = CD155 v85 IgV
WPPPGTGDVVVQAPTQVSGFLGDSVTLPCYLQVPNMEVTHVSQLTWARHGESGSMAVFHQTQGPSYSESKRLEFVAARLGAELRNASLRMFGLRVEDEGNYTCTFVTFPQGSRSVDIWLRVL

SEQ ID NO: 435 - protein, 122 aa, synthetic construct
  REGION 1..122: note = CD155 v86 IgV
WPPPGTGDVVVQAPTQVSGFLGDSVTLPCYLQVPNMEVTHVSQLTWARHGESGSMAVFHQTHGPSYSESKRLEFVAARQGAELRNASLRMSGLRVEDEGNYTCLFVTFPQGSRSVDIWLRVL

SEQ ID NO: 436 - protein, 122 aa, synthetic construct
  REGION 1..122: note = CD155 v87 IgV
WPPPGTGDVVVQAPTQVPGFLGDSVTLPCYLQVPNMEVTHVSQLQWARHGEKGSMAVFHQTFGPSYSESKRLEFVAARLGAELRNASLRMFGLRVEDEGNYTCQFVTFPQRSRSVDIWLRVL

SEQ ID NO: 437 - protein, 122 aa, synthetic construct
  REGION 1..122: note = CD155 v88 IgV
WPPPGTGDVVVQAPTQVPGFLGDSVTLPCYLQVPNMEVTHVSQLQWARHGEQGSMAVFHQTYGPSYSESKRLEFVAARLGAELRNASLRMFGLRVEDEGNYTCQFVTFPQRSRSVDIWLRVL

SEQ ID NO: 438 - protein, 122 aa, synthetic construct
  REGION 1..122: note = CD155 v89 IgV
WPPPGTGDVVVQAPTQVPGFLGDSVTLPCYLQVPNMEVTHVSQLQWARHGEQGSMAVFHQTYGPSYSESKRLEFVAARLGAELRNASLRMFGLRVEDEGNYTCEFVTFPQRSRSVDIWLRVL

SEQ ID NO: 439 - protein, 122 aa, synthetic construct
  REGION 1..122: note = CD155 v90 IgV
WPPPGTGDVVVQAPTQVPGFLGDSVTLPCYLQVPNMEVTHVSQLTWARHGESGSMAAFHQMQGPWYAESKRLEFVAARLGAELRNASLRMFGLRVDDEGNYTCTFVTFPQGSRSVDIWLRVL

SEQ ID NO: 440 - protein, 122 aa, synthetic construct
  REGION 1..122: note = CD155 v91 IgV
WPPPGTGDVVVQAPTQVLGFLGDSVTLPCYLQVPNMEVTHVSQLTWARHGESGSMATFHQSQGPYYAESKRLEFVAARLGAELRNASLRMFGLRVEDEGNYTCTFVTFPQGSRSVDIWLRVL

SEQ ID NO: 441 - protein, 122 aa, synthetic construct
  REGION 1..122: note = CD155 v92 IgV
WPPPGTGDVVVQAPTQVTGFLGDSVTLPCYLQVPNMEVTHVSQLQWARHGESGSMAVFHQTQGPSYSESKRLEFVAARLGAELRNASLRMFGLRVEDEGNYTCLFVTFPQGSRSVDIWLRVL

SEQ ID NO: 442 - protein, 122 aa, synthetic construct
  REGION 1..122: note = CD155 v93 IgV
WPPPGTGDVVVQAPTQVLGFLGDSVTLPCYLQVPNMEVTHVSQLTWARHGESGSMAAFHQMQGPWYAESKRLEFVAARLGAELRNASLRMFGLRVEDEGNYTCTFVTFPQGSRSVDIWLRVL

SEQ ID NO: 443 - protein, 122 aa, synthetic construct
  REGION 1..122: note = CD155 v94 IgV
WPPPGTGDVVVQAPTQVPGFLGDSVTLPCYLQVPNMEVTHVSQLTWARHGESGSMAVFHQMQGPWYAESKRLEFVAARLGAELRNASLRMFGLRVEDEGNYTCTFVTFPQGSRSVDIWLRVL

SEQ ID NO: 444 - protein, 122 aa, synthetic construct
  REGION 1..122: note = CD155 v95 IgV
WPPPGTGDVVVQAPTQVSGFLGDSVTLPCYLQVPNMEVTHAGQLGWARHGESGSMAVFHQTQGPSYSESKRLEFVAARLGAELRNASLRMFGLRVEDEGNYTCNFVTFPQGSRSVDIWLRVL

SEQ ID NO: 445 - protein, 122 aa, synthetic construct
  REGION 1..122: note = CD155 v96 IgV
WPPPGTGDVVVQAPTQVHGFLGDSVTLPCYLQVPNMEVTHVGQLIWARHGETRHMALFEQSQGPDYSGSKRLEFVAARLGAELRNASLRMFGLRVEDEGNYTCNFVTFPQGSRSVDIWLRVL

SEQ ID NO: 446 - protein, 122 aa, synthetic construct
  REGION 1..122: note = CD155 v97 IgV
WPPPGTGDVVVQAPTQVSGFLGDSVTLPCYLQVPNMEVTHVGQLVWARHGESGSMAVLHQTQGPSYWESKRLEFVAARLGAELRNASLRMFGLRVEDEGNYTCNFVTFPQGSRSVDIWLRVL

SEQ ID NO: 447 - protein, 122 aa, synthetic construct
  REGION 1..122: note = CD155 v98 IgV
WPPPGTGDVVVQAPTQVSGFLGDSVTLPCYLQVPNMEVTHVSQLIWARHGESGSMAVFHQTQGPSYSESKRLEFVAARLGAELRNASLRMFGLRVEDEGNYTCNFVTFPQGSRSVDIWLRVL

SEQ ID NO: 448 - protein, 122 aa, synthetic construct
  REGION 1..122: note = CD155 v99 IgV
WPPPGTGDVVVQAPTQVSGFLGDSVTLPCYLQVPNMEVTHVGQLGWARHGESGSMAVFHQTQGPSYSESKRLEFVAARLGAELRNASLRMFGLRVEDEGNYTCNFATFPQGSRSVDIWLRVL

SEQ ID NO: 449 - protein, 122 aa, synthetic construct
  REGION 1..122: note = CD155 v100 IgV
WPPPGTGDVVVQAPTQVHGFLGDSVTLPCYLQVPNMEVTRVGQLIWARHGETRHMALFEQSQGPDYSGSKRLEFVAARLGAELRNASLRMFGLRVEDEGNYTCYFLTHPQGSRSVDIWLRVL

SEQ ID NO: 450 - protein, 122 aa, synthetic construct
  REGION 1..122: note = CD155 v101 IgV
WPPPGTGDVVVQAPTQVPGFLGDSVTLPCYLQVPNMVVTHVGQLGWARHGESGSMAVFHQTQGPSYSESKRLEFVAARLGAELRNASLRMFGLRVEDEGNYTCNFVTFPQGSRSVDIWLRVL

SEQ ID NO: 451 - protein, 122 aa, synthetic construct
  REGION 1..122: note = CD155 v102 IgV
WPPPGTGDVVVQAPTQVSGFLGDSVTLPCYLQVPNMEVTHVSQLQWARHGESGSMAVFHQTQGPSYSESKRLEFVAARPGAELRNASLRMFGLRVEDEGNYTCTFVTFPQGSRSVDIWLRVL

SEQ ID NO: 452 - protein, 122 aa, synthetic construct
  REGION 1..122: note = CD155 v103 IgV
WPPPGTGDVVVQAPTQVLGFLGDSVTLPCYLQVPNMEVTHVSQLTWARHGESGSMAVFHQTRGPSYSESKRLEFVAARLGAELRNASLRMFGLRVEDEGNYTCLFVTFPQGSRSVDIWLRVL

SEQ ID NO: 453 - protein, 122 aa, synthetic construct
  REGION 1..122: note = CD155 v104 IgV
WPPPGTGDVVVQRPTQVPGFLGYSVTLPCYLQVPNMPVTHVLQLTWARHGEGGSMAVFHQTYGPSYSESKRLEFVAARLGEELRNASLRMFGLRVEDEGNYTCLFVTFPQGSRSVDIWLRVL

SEQ ID NO: 454 - protein, 122 aa, synthetic construct
  REGION 1..122: note = CD155 v105 IgV
WPPPGTGDVVVQAPTQVLGFLGDSVTLPCYLQVPNMEVTHVSQLTWARRGESGSMAVFHQTQGPSYSESKRLEFVAARLGAELRNASLRMFGLRVEDEGNYTCTFVTFPQGSRSVNIWLRVL

SEQ ID NO: 455 - protein, 122 aa, synthetic construct
  REGION 1..122: note = CD155 v106 IgV
WPPPGTGDVVVQRPTQVPGFLGYSVTLPCYLQVPNMPVTHVSQLTWARHGESGSMAVFHQTMGPSYSESKRLEFVAARLSPELRNASLRMFGLRVEDEGNYTCTFVTFPQGSRSVDIWLRVL

SEQ ID NO: 456 - protein, 122 aa, synthetic construct
  REGION 1..122: note = CD155 v107 IgV
WPPPGTGDVVVQAPTQVPGFLGDSVTLPCYLQVPNMEVTHVSQLTWARHGESGSMAVFHQTQGPTYSESKRLEFVAARLGAELRNASLRMFGLRVEDEGNYTCTFVTFPQGSRSVDIWLRVL

SEQ ID NO: 457 - protein, 122 aa, synthetic construct
  REGION 1..122: note = CD155 v108 IgV
WPPPGTGDVVVQRPTQVPGFLGYSVTLPCYLQVPNMPVTHVSQLTWARHGEGGSMAAFHQTMGPSYSESERLEFVAARLGAELRNASLRMFGLRVEDEGNYTCTFVTFPQGSRSVDIWLRVL

SEQ ID NO: 458 - protein, 122 aa, synthetic construct
  REGION 1..122: note = CD155 v109 IgV
WPPPGTGDVVVQAPTQVLGFLGDSVTLPCYLQVPNMEVTHVSQLTWVRHGESGSMAVFHQTYGPSYSESKRLDFVAARLGAELRNASLRMFGLRVEDEGNYTCTFVTFPQGSRSVDIWLRVL

SEQ ID NO: 459 - protein, 122 aa, synthetic construct
  REGION 1..122: note = CD155 v110 IgV
WPPPGTGDVVVQAPTQVPGFLGDSVTLPCYLQVPNMEVTTMSQLTWVRHGEQGSMAVFHQTLGPTYSESKRLRFVAARLGAELRNASLRMFGLRVEGSGNYTCTFVTFPQGSRSVNIWLRVL

SEQ ID NO: 460 - protein, 122 aa, synthetic construct
  REGION 1..122: note = CD155 v111 IgV
WPPPGTGDVVVQAPTQVLGFLGDSVTLPCYLQVPNMEVTHVPQLQWARHGESGSMAVFHQGQGPHYEESKRLEFVAARLGAELRNASLRMFGLRVEDEGNYTCTFVTFPQGSRSVNIWLRVL

SEQ ID NO: 461 - protein, 122 aa, synthetic construct
  REGION 1..122: note = CD155 v112 IgV
WPPPGTGDVVVQAPTQVSGFLGDSVTLPCYLQVPNMEVTTMSQLTWVRHGEQGSMAVFHQTLGPTYSESKRLRFVAARLGAELRNASLRMFGLRVEDEGNYTCMFATFPQGSRSVDIWLRVL

SEQ ID NO: 462 - protein, 122 aa, synthetic construct
  REGION 1..122: note = CD155 v113 IgV
WPPPGTGDVVVQAPTQVPGFLGDSVTLPCYLQVPNMEVTTMSQLTWVRHGEQGSMAVFHQTLGPTYSGSKRLRFVAARLGAELRNASLRMFGLRVEGSGNYTCTFVTFPQGSRSVDIWLRVL

SEQ ID NO: 463 - protein, 122 aa, synthetic construct
  REGION 1..122: note = CD155 v114 IgV
WPPPGTGDVVVQAPTQVPGFLGDSVTLPCYLQVPNMEVTHVSQLQWARHGEEGSMAVFHQTQGPSYSESKRLEFVAARLGAELRNASLRMFGLRVEDEGNYTCEFVTFPQGSRSVDIWLRVL

SEQ ID NO: 464 - protein, 122 aa, synthetic construct
  REGION 1..122: note = CD155 v115 IgV
WPPPGTGDVVVQAPTQVPGFLGDSVTLPCYLQVPNMEVTHVSQLQWARHGEEGSMAVFHQTFGPSYSESKRLEFVAARLGAELRNASLRMFGLRVEDEGNYTCEFVTFPQGSRSVDIWLRVL

SEQ ID NO: 465 - protein, 122 aa, synthetic construct
  REGION 1..122: note = CD155 v116 IgV
WPPPGTGDVVVQAPTQVFGFLGDSVMLPCYLQVPNMEVTHVSQVTWARHGESGSMAVFHQTKGPSYSESKRLEFVAARPGAELRNASLRMSGLRVEDEGNYTCMFVTFPQDSRSVDIWLRVL

SEQ ID NO: 466 - protein, 122 aa, synthetic construct
  REGION 1..122: note = CD155 v117 IgV
WPPPGTGDVVVQAPTQVSGFLGDSVTLPCYLQVPNMEVTHVSQLSWARHGESGSMAVFHQKQGPWYAESKRLEFVAARLGAELRNASLRMSGLRVEDEGNYTCLFVTFPQRSRSVDIWLRVL

SEQ ID NO: 467 - protein, 122 aa, synthetic construct
  REGION 1..122: note = CD155 v118 IgV
WPPPGTGDVVVQAPTQVSGFLGDSVTLPCYLQVPNMEVTHVSQLTWARHGESGSMAVFHQTQGPSYSESKRLEFVAARPGAELRNASLRMFGLRVEDEGNYTCMFVMFPQGSRSVDIWLRVL

SEQ ID NO: 468 - protein, 122 aa, synthetic construct
  REGION 1..122: note = CD155 v119 IgV
WPPPGTGDVVVQAPTQVSGFLGDSVTLPCYLQVPNMEVTHVSQLTWARHGESGSMAVFHQTQGPWYAESKRLEFVAARLGAELRNASLRVFGLRAEDEGNYTCQFVTFPQRSRSVDIWLRVL

SEQ ID NO: 469 - protein, 107 aa, synthetic construct
  REGION 1..107: note = PD-L1 IgV
PKDLYVVEYGSNMTIECKFPVEKQLDLAALIVYWEMEDKNIIQFVHGEEDLKVQHSSYRQRARLLKDQLSLGNAALQITDVKLQDAGVYRCMISYGGADYKRITVKV

SEQ ID NO: 470 - protein, 220 aa, synthetic construct
  REGION 1..220: note = PD-L1 ECD v1
FTVTVPKDLYVVEYGSNMTIECKFPVENQLDLAALIVYWEVEDKTIIQFVNGEEDLEVQHSSYRQRARLLKDQLSLGNAALQITDVKLQDAGVYRCMISYGGADYKRITVKVNAPYNKINQRILVVDPVTSEHELTCQAEGYPKAEVIWTSSDHQVLSGKTTTTNSKREEKLFNVTSTLRINTTTNEIFYCTFRRLDPEENHTAELVIPELPLAHPPNER

SEQ ID NO: 471 - protein, 220 aa, synthetic construct
  REGION 1..220: note = PD-L1 ECD v2
FTVTVPKDLYVVEYGSNMTLECKFPVEKQLDLAALTVYWEMEDKDITQFVHGEEDLKVQHSSYRQRARLLKDQLSLGNAALQITDVKLQDAGVYRCMISYGGADYKRITVKVNAPYNKINQRILVVDPVTSEHELTCQAEGYPKAEVIWTSSDHQVLSGKTTTTNSKREEKLFNVTSTLRINTTTNEIFYCTFRRLDPEENHTAELVIPELPLAHPPNER

SEQ ID NO: 472 - protein, 220 aa, synthetic construct
  REGION 1..220: note = PD-L1 ECD v3
FTVTVPKDLYVVEYGSNMTLECKFPVEKQLDLAALIVYWEKEDENIIQFVHGEEDLKVQHSSYRQRARLLKDQLSLGNAALQITDVKLQDAGVYRCMISYGGADYKRITVKVNAPYNKINQRILVVDPVTSEHELTCQAEGYPKAEVIWTSSDHQVLSGKTTTTNSKREEKLFNVTSTLRINTTTNEIFYCTFRRLDPEENHTAELVIPELPLAHPPNER

SEQ ID NO: 473 - protein, 220 aa, synthetic construct
  REGION 1..220: note = PD-L1 ECD v4
FTVTVSKDLYVVEYGSNMTIECKFPVEKQLDLAALIVYWEMEDKTIIQFVHGEEDLKVQHSSYRQRARLLKDQLSLGIAALQTTDVKLQDAGVYRCMISYGGADYKRITVKVNAPYNKINQRILVVDPVTSEHELTCQAEGYPKAEVIWTSSDHQVLSGKTTTTNSKREEKLFNVTSTLRINTTTNEIFYCTFRRLDPEENHTAELVIPELPLAHPPNER

SEQ ID NO: 474 - protein, 220 aa, synthetic construct
  REGION 1..220: note = PD-L1 ECD v5
FTVTVPKDLYVVEYGSNMTIECKFPVEKQLDLAALIVYWEMEDKNIIQFVHGEEDLKVQHSSYRQRARLLKDQLSLGIAALQITDVKLQDAGVYRCMISYGGADYKRITVKVNAPYNKINQRILVVDPVTSEHELTCQAEGYPKAEVIWTSSDHQVLSGKTTTTNSKREEKLFNVTSTLRINTTTNEIFYCTFRRLDPEENHTAELVIPELPLAHPPNER

SEQ ID NO: 475 - protein, 220 aa, synthetic construct
  REGION 1..220: note = PD-L1 ECD v6
FTVTVPKDLYVVEYGSNMTIECKFPVEKQLDLAALIVYWEKEDKNIIQFVHGEEDLKVQHSSYRQRARLLKDQLSLGIAALQITDVKLQDAGVYRCMISYGGADYKRITVKVNAPYNKINQRILVVDPVTSEHELTCQAEGYPKAEVIWTSSDHQVLSGKTTTTNSKREEKLFNVTSTLRINTTTNEIFYCTFRRLDPEENHTAELVIPELPLAHPPNER

SEQ ID NO: 476 - protein, 220 aa, synthetic construct
  REGION 1..220: note = PD-L1 ECD v7
FTVTVPKDLYVVEYGSNMTIECKFPVEKQLDLAALIVYWEMEDKTIIQFVHGEEDLKVQHSSYRQRARLLKDQLSLGIAALQITDVKLQDAGVYRCMISYGGADYKRITVKVNAPYNKINQRILVVDPVTSEHELTCQAEGYPKAEVIWTSSDHQVLSGKTTTTNSKREEKLFNVTSTLRINTTTNEIFYCTFRRLDPEENHTAELVIPELPLAHPPNER

SEQ ID NO: 477 - protein, 220 aa, synthetic construct
  REGION 1..220: note = PD-L1 ECD v8
FTVTVPKDLYVVEYGSNMTLECKFPVEKQLDLAALIVYWEMEDKTIIQFVHGEEDLKVQHSSYRQRARLLKDQLSLGNAALQITDVKLQDAGVYRCMISYGGADYKRITVKVNAPYNKINQRILVVDPVTSEHELTCQAEGYPKAEVIWTSSDHQVLSGKTTTTNSKREEKLFNVTSTLRINTTTNEIFYCTFRRLDPEENHTAELVIPELPLAHPPNER

SEQ ID NO: 478 - protein, 220 aa, synthetic construct
  REGION 1..220: note = PD-L1 ECD v9
FTVTVPKDLYVVEYGSNMTIECKFPVEKQLDLAALIVYWEMEDKTIIQFVHGEEDLKVQHSSYRQRARLLKDQLSLGNAALQITDVKLQDAGVYRCMISYGGADYKRITVKVNAPYNKINQRILVVDPVTSEHELTCQAEGYPKAEVIWTSSDHQVLSGKTTTTNSKREEKLFNVTSTLRINTTTNEIFYCTFRRLDPEENHTAELVIPELPLAHPPNER

SEQ ID NO: 479 - protein, 220 aa, synthetic construct
  REGION 1..220: note = PD-L1 ECD v10
FTVTVPKDLYVVEYGSNMTIECKFPVEKQLDLAALIVYWEKEDKNIIQFVHGEEDLKVQHSSYRQRARLLKDQLSLGNAALQITDVKLQDAGVYRCMISYGGADYKRITVKVNAPYNKINQRILVVDPVTSEHELTCQAEGYPKAEVIWTSSDHQVLSGKTTTTNSKREEKLFNVTSTLRINTTTNEIFYCTFRRLDPEENHTAELVIPELPLAHPPNER

SEQ ID NO: 480 - protein, 220 aa, synthetic construct
  REGION 1..220: note = PD-L1 ECD v11
FTVTVPKDLYVVEYGSNMTLECKFPVEKQLDLAALTVYWEMEDKDIIQFVHGEEDLKVQHSSYRQRARLLKDQLSLGNAALQITDVKLQDAGVYRCMISYGGADYKRITVKVNAPYNKINQRILVVDPVTSEHELTCQAEGYPKAEVIWTSSDHQVLSGKTTTTNSKREEKLFNVTSTLRINTTTNEIFYCTFRRLDPEENHTAELVIPELPLAHPPNER

SEQ ID NO: 481 - protein, 220 aa, synthetic construct
  REGION 1..220: note = PD-L1 ECD v12
FTVTVPKDLYVVEYGSDMTIECKFPVEKQLDLAALIVYWEMEDKTIIQFAHGEEDLKVQHSSYRQRARLLKGQLSLGNAALQITDVKLQDAGVYRCMISYGGADYKRITVKVNAPYNKINQRILVVDPVTSEHELTCQAEGYPKAEVIWTSSDHQVLSGKTTTTNSKREEKLFNVTSTLRINTTTNEIFYCTFRRLDPEENHTAELVIPELPLAHPPNER

SEQ ID NO: 482 - protein, 220 aa, synthetic construct
  REGION 1..220: note = PD-L1 ECD v13
FTVTVPKDLYVVEYGSNMTLECKFPVEKQLDLAALIVYWEMEDKNIIQSVHGEEDLKVQHSSYRQRARLLKDQLSLGNAALQITDVKLQDAGVYRCMISYGGADYKRITVKVNAPYNKINQRILVVDPVTSEHELTCQAEGYPKAEVIWTSSDHQVLSGKTTTTNSKREEKLFNVTSTLRINTTTNEIFYCTFRRLDPEENHTAELVIPELPLAHPPNER

SEQ ID NO: 483 - protein, 220 aa, synthetic construct
  REGION 1..220: note = PD-L1 ECD v14
FTVTVPKDLYVVEYGSNMTIECKFPVEKQLDLAALIVYWEMEDKTIIQFAHGEEDLKVQHSSYRQRARLLKDQLSLGNAALQITDVKLQDAGVYRCMISYGGADYKRITVKVNAPYNKINQRILVVDPVTSEHELTCQAEGYPKAEVIWTSSDHQVLSGKTTTTNSKREEKLFNVTSTLRINTTTNEIFYCTFRRLDPEENHTAELVIPELPLAHPPNER

SEQ ID NO: 484 - protein, 220 aa, synthetic construct
  REGION 1..220: note = PD-L1 ECD v15
FTVTVPKDLYVVEYGSNMTLECKFPVEKQLDLAALIVYWEMEDKTIIQFVHGEEDLKVQHSSYRQRARLLKDQLSLGIAALQITDVKLQDAGVYRCMISYGGADYKRITVKVNAPYNKINQRILVVDPVTSEHELTCQAEGYPKAEVIWTSSDHQVLSGKTTTTNSKREEKLFNVTSTLRINTTTNEIFYCTFRRLDPEENHTAELVIPELPLAHPPNER

SEQ ID NO: 485 - protein, 220 aa, synthetic construct
  REGION 1..220: note = PD-L1 ECD v16
FTVTVPKDLYVVEYGSNMTLECKFPVEKQLDLAALIVYWEMEDKTIIQFAHGEEDLKVQHSSYRQRARLLKDQLSLGNAALQITDVKLQDAGVYRCMISYGGADYKRITVKVNAPYNKINQRILVVDPVTSEHELTCQAEGYPKAEVIWTSSDHQVLSGKTTTTNSKREEKLFNVTSTLRINTTTNEIFYCTFRRLDPEENHTAELVIPELPLAHPPNER

SEQ ID NO: 486 - protein, 220 aa, synthetic construct
  REGION 1..220: note = PD-L1 ECD v17
FTVTVPKDLYVVEYGSNMTIECKFPVEKQLDLAALIVYWEVEDKTIIQFVHGEEDLKVQHSSYRQRARLLKDQLSLGNAALQITDVKLQDAGVYRCMISYGGADYKRITVKVNAPYNKINQRILVVDPVTSEHELTCQAEGYPKAEVIWTSSDHQVLSGKTTTTNSKREEKLFNVTSTLRINTTTNEIFYCTFRRLDPEENHTAELVIPELPLAHPPNER

SEQ ID NO: 487 - protein, 220 aa, synthetic construct
  REGION 1..220: note = PD-L1 ECD v18
FTVTVPKDLYVVEYGSNMTIECKFPVEKQLDLAALIVYWEKEDKTIIQFVHGEEDLKVQHSSYRQRARLLKDQLSLGNAALQITDVKLQDAGVYRCMISYGGADYKRITVKVNAPYNKINQRILVVDPVTSEHELTCQAEGYPKAEVIWTSSDHQVLSGKTTTTNSKREEKLFNVTSTLRINTTTNEIFYCTFRRLDPEENHTAELVIPELPLAHPPNER

SEQ ID NO: 488 - protein, 220 aa, synthetic construct
  REGION 1..220: note = PD-L1 ECD v19
FTVTVPKDLYVVEYGSNMTIECKFPVEKQLDLDALIVYWEMEDKNIIQFVHGEEDLKVQHSSYRQRARLLKDQLPLGNAALQITEVKLQDAGVYRCMISYGGADYKRITVKVNAPYNKINQRILVVDPVTSEHELTCQAEGYPKAEVIWTSSDHQVLSGKTTTTNSKREEKLFNVTSTLRINTTTNEIFYCTFRRLDPEENHTAELVIPELPLAHPPNER

SEQ ID NO: 489 - protein, 220 aa, synthetic construct
  REGION 1..220: note = PD-L1 ECD v20
FTVTVPKDLYVVEYGSNITIECKFPVEKQLDLAALIVYWEKEGKNIIQFVRGEEDLKVQHSSYRQRARLLKDQLSLGIAALQITDVKLQDAGVYRCMISYGGADYKRITVKVNAPYNKINQRILVVDPVTSEHELTCQAEGYPKAEVIWTSSDHQVLSGKTTTTNSKREEKLFNVTSTLRINTTTNEIFYCTFRRLDPEENHTAELVIPELPLAHPPNER

SEQ ID NO: 490 - protein, 220 aa, synthetic construct
  REGION 1..220: note = PD-L1 ECD v21
FTVTVPKDLYEVEYGSNMTLECKFPVEKQLDLAALTVYWEMEDKDIIQFVHGEEDLKVQRSSYRQRARLLKDQLPLGNAALQITDVKLQDAGVYRCMISYGGADYKRITVKVNAPYNKINQRILVVDPVTSEHELTCQAEGYPKAEVIWTSSDHQVLSGKTTTTNSKREEKLFNVTSTLRINTTTNEIFYCTFRRLDPEENHTAELVIPELPLAHPPNER

SEQ ID NO: 491 - protein, 220 aa, synthetic construct
  REGION 1..220: note = PD-L1 ECD v22
FTVTVPKDLYVVEYGSNMTIECKFPVEKQLDLDALIVYWEMEDKNIIQFAHGEEDLKVQHSSYRQRARLLKDQLSLGNAALQITDVKLQDAGVYRCMISYGGADYKRITVKVNAPYNKINQRILVVDPVTSEHELTCQAEGYPKAEVIWTSSDHQVLSGKTTTTNSKREEKLFNVTSTLRINTTTNEIFYCTFRRLDPEENHTAELVIPELPLAHPPNER

SEQ ID NO: 492 - protein, 220 aa, synthetic construct
  REGION 1..220: note = PD-L1 ECD v23
FTVTVPKDLYVVEYGGNMTIECKFPVEKQLDLDALIVYWEMEDKNIIQFVHGEEDLKVQHSSYRQRARLLEDQLPLGNAALQITDVKLQDAGVYRCMISYGGADYKRITVKVNAPYNKINQRILVVDPVTSEHELTCQAEGYPKAEVIWTSSDHQVLSGKTTTTNSKREEKLFNVTSTLRINTTTNEIFYCTFRRLDPEENHTAELVIPELPLAHPPNER

SEQ ID NO: 493 - protein, 220 aa, synthetic construct
  REGION 1..220: note = PD-L1 ECD v24
FTVTVPKDLYVVEYGSNMTIECKFPVGKQLDLAALIVYWEMEDKTIIQFVHGEEDLKVQHSSYRQRARLLKDQLSLGNAALQITDVKLQDAGVYRCIISYGGADYKRITVKVNAPYNKINQRILVVDPVTSEHELTCQAEGYPKAEVIWTSSDHQVLSGKTTTTNSKREEKLFNVTSTLRINTTTNEIFYCTFRRLDPEENHTAELVIPELPLAHPPNER

SEQ ID NO: 494 - protein, 220 aa, synthetic construct
  REGION 1..220: note = PD-L1 ECD v25
FTVTVPKDLYVVEYGSNMTIECKFPVGKQLDLAALIVYWEMEDKTIIQFVHGEEDLRVQHSSYRQRARLLKDQLSLGNAALQITDVKLQDAGVYRCMISYGGADYKRITVKVNAPYNKINQRILVVDPVTSEHELTCQAEGYPKAEVIWTSSDHQVLSGKTTTTNSKREEKLFNVTSTLRINTTTNEIFYCTFRRLDPEENHTAELVIPELPLAHPPNER

SEQ ID NO: 495 - protein, 220 aa, synthetic construct
  REGION 1..220: note = PD-L1 ECD v26
FTVTVPKDLYVVEYGSNMTIECKFPVEKQLDLDALIVYWEMEDKNIIQFVHGVEDLKVQHSSYRQRARLLKDQLSLGNAALQITDVKLQDAGVYRCMISYGGADYKRITVKVNAPYNKINQRILVVDPVTSEHELTCQAEGYPKAEVIWTSSDHQVLSGKTTTTNSKREEKLFNVTSTLRINTTTNEIFYCTFRRLDPEENHTAELVIPELPLAHPPNER

SEQ ID NO: 496 - protein, 220 aa, synthetic construct
  REGION 1..220: note = PD-L1 ECD v27
FTVTVPKDLYVVEYGSNMTIECKFPVEKQLDLAALIVYWEMEGKDIIQFVHGEEDLKAQHSSYRQRARLLKDQLSLGNAALQITDVKLQDAGVYRCMISYGGADYKRITVKVNAPYNKINQRILVVDPVTSEHELTCQAEGYPKAEVIWTSSDHQVLSGKTTTTNSKREEKLFNVTSTLRINTTTNEIFYCTFRRLDPEENHTAELVIPELPLAHPPNER

SEQ ID NO: 497 - protein, 220 aa, synthetic construct
  REGION 1..220: note = PD-L1 ECD v28
FTVTVPKDLYVVEYGSNMTIECKFPVEKQLDLAALIVYWGMEVKTIIQFAHGEEDLKVQHSSYRQRARLLKDQLSLGNAALQITDVKLQDAGVYRCMISYGGADYKRITVKVNAPYNKINQRILVVDPVTSEHELTCQAEGYPKAEVIWTSSDHQVLSGKTTTTNSKREEKLFNVTSTLRINTTTNEIFYCTFRRLDPEENHTAELVIPELPLAHPPNER

SEQ ID NO: 498 - protein, 220 aa, synthetic construct
  REGION 1..220: note = PD-L1 ECD v29
FTVTVPKDLYVVESGSNMTIECKFPVEEQLDLAALIVYWEMEDKTIIQFVHGEEDLKVQHSSYRQRARLLKDQLSLGNAALQITDVKLQDAGVYRCMISYGGADYKRITVKVNAPYNKINQRILVVDPVTSEHELTCQAEGYPKAEVIWTSSDHQVLSGKTTTTNSKREEKLFNVTSTLRINTTTNEIFYCTFRRLDPEENHTAELVIPELPLAHPPNER

SEQ ID NO: 499 - protein, 220 aa, synthetic construct
  REGION 1..220: note = PD-L1 ECD v30
FTVTVPKDLYVVEYGSNMTIECKFPVEKQLDLDALIVYWEMEDKNIIQFVHGEEDLKVQHSSYRQRARLLKDQLSLGSAALQITDVKLQDAGVYRCMISYGGADYKRITVKVNAPYNKINQRILVVDPVTSEHELTCQAEGYPKAEVIWTSSDHQVLSGKTTTTNSKREEKLFNVTSTLRINTTTNEIFYCTFRRLDPEENHTAELVIPELPLAHPPNER

SEQ ID NO: 500 - protein, 220 aa, synthetic construct
  REGION 1..220: note = PD-L1 ECD v31
FTVTVPKDLYVVEYGSNMTIECKFPVEKQLDLDALIVYWEMEDKNIIQFVHGEEDLKVQHSSYRQRARLLKDQLSLGIAALQITDVKLQDAGVYRCMISYGGADYKRITVKVNAPYNKINQRILVVDPVTSEHELTCQAEGYPKAEVIWTSSDHQVLSGKTTTTNSKREEKLFNVTSTLRINTTTNEIFYCTFRRLDPEENHTAELVIPELPLAHPPNER

SEQ ID NO: 501 - protein, 220 aa, synthetic construct
  REGION 1..220: note = PD-L1 ECD v32
FTVTVPKDLYVVEYGSNMTIECKFPVEKQLDLDALIVYWEMEDKTIIQFVHGEEDLKVQHSSYRQRARLLKDQLSLGNAALQITDVKLQDAGVYRCMISYGGADYKRITVKVNAPYNKINQRILVVDPVTSEHELTCQAEGYPKAEVIWTSSDHQVLSGKTTTTNSKREEKLFNVTSTLRINTTTNEIFYCTFRRLDPEENHTAELVIPELPLAHPPNER

SEQ ID NO: 502 - protein, 220 aa, synthetic construct
  REGION 1..220: note = PD-L1 ECD v33
FTVTVPKDLYVVEYGSNMTIECKFPVEKQLDLDALIVYWEMEDKTIIQFVHGEEDLKVQHSSYRQRARLLKDQLSLGIAALQITDVKLQDAGVYRCMISYGGADYKRITVKVNAPYNKINQRILVVDPVTSEHELTCQAEGYPKAEVIWTSSDHQVLSGKTTTTNSKREEKLFNVTSTLRINTTTNEIFYCTFRRLDPEENHTAELVIPELPLAHPPNER

SEQ ID NO: 503 - protein, 220 aa, synthetic construct
  REGION 1..220: note = PD-L1 ECD v34
FTVTVPKDLYVVEYGSNMTIECKFPVGKQLDLAALIVYWEMEDKTIIQFAHGEEDLKVQHSSYRQRARLLKDQLSLGNAALQITDVKLQDAGVYRCMISYGGADYKRITVKVNAPYNKINQRILVVDPVTSEHELTCQAEGYPKAEVIWTSSDHQVLSGKTTTTNSKREEKLFNVTSTLRINTTTNEIFYCTFRRLDPEENHTAELVIPELPLAHPPNER

SEQ ID NO: 504 - protein, 220 aa, synthetic construct
  REGION 1..220: note = PD-L1 ECD v35
FTVTVPKDLYVVEYGSNMTIECKFPVEKQLDLAALIVYWEMEDKTIIQFAHGEEDLKVQHSSYRQRARLLKDQLSLGSAALQITDVKLQDAGVYRCMISYGGADYKRITVKVNAPYNKINQRILVVDPVTSEHELTCQAEGYPKAEVIWTSSDHQVLSGKTTTTNSKREEKLFNVTSTLRINTTTNEIFYCTFRRLDPEENHTAELVIPELPLAHPPNER

SEQ ID NO: 505 - protein, 220 aa, synthetic construct
  REGION 1..220: note = PD-L1 ECD v36
FTVTVPKDLYVVEYGSNMTLECKFPVEKQLDLAALIVYWEMEDKTIIQFVHGEEDLKVQHSSYRQRARLLKDQLSLGNAALQITDVKLQDAGVYRCMISYGGADYKRITMKVNAPYNKINQRILVVDPVTSEHELTCQAEGYPKAEVIWTSSDHQVLSGKTTTTNSKREEKLFNVTSTLRINTTTNEIFYCTFRRLDPEENHTAELVIPELPLAHPPNER

SEQ ID NO: 506 - protein, 220 aa, synthetic construct
  REGION 1..220: note = PD-L1 ECD v37
FTVTVPKDLYVVEYGSNMTLECKFPVEKQLDLAALTVYWEMEDKTIIQFAHGEEDLKVQHSSYRQRARLLKDQLSLGNAALQITDVKLQDAGVYRCMISYGGADYKRITVKVNAPYNKINQRILVVDPVTSEHELTCQAEGYPKAEVIWTSSDHQVLSGKTTTTNSKREEKLFNVTSTLRINTTTNEIFYCTFRRLDPEENHTAELVIPELPLAHPPNER

SEQ ID NO: 507 - protein, 220 aa, synthetic construct
  REGION 1..220: note = PD-L1 ECD v38
FTVTVPKDLYVVEYGSNMTIECKFPVEKQLDLAALIVYWEMEDKTIIQFVHGEEDLKVQHSSYRQRARLLKDQPPLGNAALQITDVKLQDAGVYRCMISYGGADYKRITVKVNAPYNKINQRILVVDPVTSEHELTCQAEGYPKAEVIWTSSDHQVLSGKTTTTNSKREEKLFNVTSTLRINTTTNEIFYCTFRRLDPEENHTAELVIPELPLAHPPNER

SEQ ID NO: 508 - protein, 220 aa, synthetic construct
  REGION 1..220: note = PD-L1 ECD v39
FTVTVPKDLYVVEYGSNMTIECKFPVEKQLDLAALIVYWEMEDKTIIQFVHGEEDLKVQHSSYRQRARLLKDQLPLGNAALQITDVKLQDAGVYRCMISYGGADYKRITVKVNAPYNKINQRILVVDPVTSEHELTCQAEGYPKAEVIWTSSDHQVLSGKTTTTNSKREEKLFNVTSTLRINTTTNEIFYCTFRRLDPEENHTAELVIPELPLAHPPNER

SEQ ID NO: 509 - protein, 220 aa, synthetic construct
  REGION 1..220: note = PD-L1 ECD v40
FTVTVPKDLYVVEYGSNMTIECKFPVEKQLDLAALIVYWEMEDKNIIQFVHGEEDLKVQHSSYRQRARLLKDQLPLGNAALQITDVKLQDAGVYRCMISYGGADYRRITVKVNAPYNKINQRILVVDPVTSEHELTCQAEGYPKAEVIWTSSDHQVLSGKTTTTNSKREEKLFNVTSTLRINTTTNEIFYCTFRRLDPEENHTAELVIPELPLAHPPNER

SEQ ID NO: 510 - protein, 220 aa, synthetic construct
  REGION 1..220: note = PD-L1 ECD v41
FTVTVPKDLYVVEYGSNMTIECKFPVEKQLDLAALIVYWEMEDKNIIQFVHGEEDLKVQHSSYRQRARLLKDQLPLGNAALQITDVKLQDAGVYRCMISYGGADYKRITVKVNAPYNKINQRILVVDPVTSEHELTCQAEGYPKAEVIWTSSDHQVLSGKTTTTNSKREEKLFNVTSTLRINTTTNEIFYCTFRRLDPEENHTAELVIPELPLAHPPNER

SEQ ID NO: 511 - protein, 220 aa, synthetic construct
  REGION 1..220: note = PD-L1 ECD v42
FTVTVPKDLYVVEYGSNMTIECKFPVEKQLDLDALIVYWEMEDKNIIQFVHGEEDLKVQHSSYRQRARLLKDQLPLGNAALQITDVKLQDAGVYRCVISYGGADYKRITVKVNAPYNKINQRILVVDPVTSEHELTCQAEGYPKAEVIWTSSDHQVLSGKTTTTNSKREEKLFNVTSTLRINTTTNEIFYCTFRRLDPEENHTAELVIPELPLAHPPNER

SEQ ID NO: 512 - protein, 220 aa, synthetic construct
  REGION 1..220: note = PD-L1 ECD v43
FTVTVPKDLYVVEYGSNMTIECKFPVEKQLDLDALIVYWEMEDKNIIQFVHGEEDLKVQHSSYRQRARLLKDQLPLGNAALQITDVKLQDAGVYRCMISYGGAGYKRITVKVNAPYNKINQRILVVDPVTSEHELTCQAEGYPKAEVIWTSSDHQVLSGKTTTTNSKREEKLFNVTSTLRINTTTNEIFYCTFRRLDPEENHTAELVIPELPLAHPPNER

SEQ ID NO: 513 - protein, 220 aa, synthetic construct
  REGION 1..220: note = PD-L1 ECD v44
FTVTVPKDLYVVEYGSNMTIECKFPVEKQLDLDALIVYWEMEDKNIIQFVHGEEDLKVQHSSYRQRARLLKDQLPLGNAALQITDVKLQDAGVYRCMISYGGADYKRITVKVNAPYNKINQRILVVDPVTSEHELTCQAEGYPKAEVIWTSSDHQVLSGKTTTTNSKREEKLFNVTSTLRINTTTNEIFYCTFRRLDPEENHTAELVIPELPLAHPPNER

SEQ ID NO: 514 - protein, 220 aa, synthetic construct
  REGION 1..220: note = PD-L1 ECD v45
FTVTVPKDLYVVEYGSNMTLECKFPVGKQLDLAALIVYWEMEDKTIIQFAHGEEDLKVQHSSYRQRARLLKDQLSLGNAALQITDVKLQDAGVYRCMISYGGADYKRITVKVNAPYNKINQRILVVDPVTSEHELTCQAEGYPKAEVIWTSSDHQVLSGKTTTTNSKREEKLFNVTSTLRINTTTNEIFYCTFRRLDPEENHTAELVIPELPLAHPPNER

SEQ ID NO: 515 - protein, 220 aa, synthetic construct
  REGION 1..220: note = PD-L1 ECD v46
FTVTVPKDLYVVEYGSNMTLECKFPVGKQLDLAALIVYWEMEGKDIIQFVHGEEDLKAQHSSYRQRARLLKDQLSLGIAALQITDVKLQDAGVYRCMISYGGADYKRITVKVNAPYNKINQRILVVDPVTSEHELTCQAEGYPKAEVIWTSSDHQVLSGKTTTTNSKREEKLFNVTSTLRINTTTNEIFYCTFRRLDPEENHTAELVIPELPLAHPPNER

SEQ ID NO: 516 - protein, 220 aa, synthetic construct
  REGION 1..220: note = PD-L1 ECD v47
FTVTVPKDLYVVEYGSNMTLECKFPVEKQLDLAALIVYWEMEGKDIIQFVHGEEDLKAQHSSYRQRARLLKDQLSLGIAALQITDVKLQDAGVYRCMISYGGADYKRITVKVNAPYNKINQRILVVDPVTSEHELTCQAEGYPKAEVIWTSSDHQVLSGKTTTTNSKREEKLFNVTSTLRINTTTNEIFYCTFRRLDPEENHTAELVIPELPLAHPPNER

SEQ ID NO: 517 - protein, 220 aa, synthetic construct
  REGION 1..220: note = PD-L1 ECD v48
FTVTVPKDLYVVEYGSNMTLECKFPVEKQLDLDALIVYWEMEGKDIIQFVHGEEDLKAQHSSYRQRARLLKDQLSLGIAALQITDVKLQDAGVYRCMISYGGADYKRITVKVNAPYNKINQRILVVDPVTSEHELTCQAEGYPKAEVIWTSSDHQVLSGKTTTTNSKREEKLFNVTSTLRINTTTNEIFYCTFRRLDPEENHTAELVIPELPLAHPPNER

SEQ ID NO: 518 - protein, 220 aa, synthetic construct
  REGION 1..220: note = PD-L1 ECD v49
FTVTVPKDLYVVEYGSNMTLECKFPVEKQLDLAALIVYWEMEGKDIIQFVHGEEDLKVQHSSYRQRARLLKDQLSLGIAALQITDVKLQDAGVYRCMISYGGADYKRITVKVNAPYNKINQRILVVDPVTSEHELTCQAEGYPKAEVIWTSSDHQVLSGKTTTTNSKREEKLFNVTSTLRINTTTNEIFYCTFRRLDPEENHTAELVIPELPLAHPPNER

SEQ ID NO: 519 - protein, 220 aa, synthetic construct
  REGION 1..220: note = PD-L1 ECD v50
FTVTVPKDLYVVEYGSNMTIECKFPVGKQLDLAALIVYWEMEDKTIIQFAHGEEDLKVQHSSYRQRARLLKDQLSLGIAALQITDVKLQDAGVYRCMISYGGADYKRITVKVNAPYNKINQRILVVDPVTSEHELTCQAEGYPKAEVIWTSSDHQVLSGKTTTTNSKREEKLFNVTSTLRINTTTNEIFYCTFRRLDPEENHTAELVIPELPLAHPPNER

SEQ ID NO: 520 - protein, 220 aa, synthetic construct
  REGION 1..220: note = PD-L1 ECD v51
FTVTVPKDLYVVEYGSNMTIECKFPVEKQLDLAALIVYWEMEDKTIIQFAHGEEDLKVQHSSYRQRARLLKDQLSLGIAALQITDVKLQDAGVYRCMISYGGADYKRITVKVNAPYNKINQRILVVDPVTSEHELTCQAEGYPKAEVIWTSSDHQVLSGKTTTTNSKREEKLFNVTSTLRINTTTNEIFYCTFRRLDPEENHTAELVIPELPLAHPPNER

SEQ ID NO: 521 - protein, 220 aa, synthetic construct
  REGION 1..220: note = PD-L1 ECD v52
FTVTVPKDLYAVEYGSNMTLECKFPVGKQLDLAALIVYWEMEGKDIIQFVYGEEDLKVQHSSYRQRARLLKDQLSLGNAALQITDVKLQDAGVYRCMIGYGGADYKRITVKVNAPYNKINQRILVVDPVTSEHELTCQAEGYPKAEVIWTSSDHQVLSGKTTTTNSKREEKLFNVTSTLRINTTTNEIFYCTFRRLDPEENHTAELVIPELPLAHPPNER

SEQ ID NO: 522 - protein, 220 aa, synthetic construct
  REGION 1..220: note = PD-L1 ECD v53
FTVTVPKDLYVVEYGSNMTLECKFPVGKQLDLAALIVYWEMEGKTIIQFAHGEEDLKVQHSSYRQRARLLKDQLSLGNAALQITDVKLQDAGVYRCMISYGGADYKRITVKVNAPYNKINQRILVVDPVTSEHELTCQAEGYPKAEVIWTSSDHQVLSGKTTTTNSKREEKLFNVTSTLRINTTTNEIFYCTFRRLDPEENHTAELVIPELPLAHPPNER

SEQ ID NO: 523 - protein, 220 aa, synthetic construct
  REGION 1..220: note = PD-L1 ECD v54
FTVTVPKDLYVVEYGSNMTLECKFPVEEQLDLAALIVYWEMEGKDIIQFVHGEEDLKAQHSSYRQRARLLKDQLSLGNAALQITDVKLRDAGVYRCMISYGGADYKRITVKVNAPYNKINQRILVVDPVTSEHELTCQAEGYPKAEVIWTSSDHQVLSGKTTTTNSKREEKLFNVTSTLRINTTTNEIFYCTFRRLDPEENHTAELVIPELPLAHPPNER

SEQ ID NO: 524 - protein, 220 aa, synthetic construct; identical to SEQ ID NO: 480
  REGION 1..220: note = PD-L1 ECD v55

SEQ ID NO: 525 - protein, 220 aa, synthetic construct
  REGION 1..220: note = PD-L1 ECD v56
FTVTVPKDLYVVEYGSNMTLECKFPVEEQLDLAALIVYWEMEGKDIIQFVHGGEDLKAQHSSYRQRARLLKDQLSLGIAALQITDVKLQDAGVYRCMISYGGADYKRITVKVNAPYNKINQRILVVDPVTSEHELTCQAEGYPKAEVIWTSSDHQVLSGKTTTTNSKREEKLFNVTSTLRINTTTNEIFYCTFRRLDPEENHTAELVIPELPLAHPPNER

SEQ ID NO: 526 - protein, 220 aa, synthetic construct
  REGION 1..220: note = PD-L1 ECD v57
FTVTVPKDLYVVEYGSNMTIECKFPVEKQLDLDALIVYWEMEGKDIIQFVHGEEDLKAQHSSYRQRARLLKDQLPLGNAALQITDVKLQDAGVYRCMISYGGADYKRITVKVNAPYNKINQRILVVDPVTSEHELTCQAEGYPKAEVIWTSSDHQVLSGKTTTTNSKREEKLFNVTSTLRINTTTNEIFYCTFRRLDPEENHTAELVIPELPLAHPPNER

SEQ ID NO: 527 - protein, 220 aa, synthetic construct
  REGION 1..220: note = PD-L1 ECD v58
FTVTVPKDLYVVEYGSNMTIECRFPVEKQLDLAALIVYWEMEGKDIIQFVHGEEDLKVQHSSYRQRARLLKDQLSLGNAALQITDVKLQDAGVYRCMISYGGADYKRITVKVNAPYNKINQRILVVDPVTSEHELTCQAEGYPKAEVIWTSSDHQVLSGKTTTTNSKREEKLFNVTSTLRINTTTNEIFYCTFRRLDPEENHTAELVIPELPLAHPPNER

SEQ ID NO: 528 - protein, 220 aa, synthetic construct
  REGION 1..220: note = PD-L1 ECD v59
FTVTVPKDLYVVEYGSNMTLECKFPVEKQLDLAALIVYWEMEGKDIIQFVHGEEDLKAQHSSYRQRARLLKDQLSLGIAALQITDVKLQGAGVYRCMISYDGADYKRITVKVNAPYNKINQRILVVDPVTSEHELTCQAEGYPKAEVIWTSSDHQVLSGKTTTTNSKREEKLFNVTSTLRINTTTNEIFYCTFRRLDPEENHTAELVIPELPLAHPPNER

SEQ ID NO: 529 - protein, 221 aa, synthetic construct
  REGION 1..221: note = PD-L1 ECD v60
FTVTVPKDLYVVEYGSNMTIECKFPVEKQLDLAALIVYWEMEGKDIIQFVHGEEDQKAQHSSYRQRARLLKDQLSLGNAALQITDVKLQDAGVYRCMISYGGGADYKRITVKVNAPYNKINQRILVVDPVTSEHELTCQAEGYPKAEVIWTSSDHQVLSGKTTTTNSKREEKLFNVTSTLRINTTTNEIFYCTFRRLDPEENHTAELVIPELPLAHPPNER

SEQ ID NO: 530 - protein, 220 aa, synthetic construct
  REGION 1..220: note = PD-L1 ECD v61
FTVTVPKDLYVVEYGSNMTLECEFPVEKQLDLAALIVYWEMEGKDIIQFVHGEEDLKAQHSSYRQRARLLKDQLSLGIAALQITDVKLQDAGVYRCMISYGGADYKRITVKVNAPYNKINQRILVVDPVTSEHELTCQAEGYPKAEVIWTSSDHQVLSGKTTTTNSKREEKLFNVTSTLRINTTTNEIFYCTFRRLDPEENHTAELVIPELPLAHPPNER

SEQ ID NO: 531 - protein, 220 aa, synthetic construct
  REGION 1..220: note = PD-L1 ECD v62
FTVTVPKDLYVVEYGSNMTLECEFPVEKQLDLAALIVYWEMEGKDIIQFAHGEEDLKVQHSSYRQRARLLKDQLSLGIAALQITDVKLQDAGVYRCMISYGGADYKRITVKVNAPYNKINQRILVVDPVTSEHELTCQAEGYPKAEVIWTSSDHQVLSGKTTTTNSKREEKLFNVTSTLRINTTTNEIFYCTFRRLDPEENHTAELVIPELPLAHPPNER

SEQ ID NO: 532 - protein, 220 aa, synthetic construct
  REGION 1..220: note = PD-L1 ECD v63
FTVTVPKDLYVVEYGSNMIIECKFPVGKQLDLAALIVYWEMEDKIIIQFAHGEEDLKVQHSSYRQRARLLKDQLSLGIAALQITDVKLQDAGVYRCKISYGGADYKRITVKVNAPYNKINQRILVVDPVTSEHELTCQAEGYPKAEVIWTSSDHQVLSGKTTTTNSKREEKLFNVTSTLRINTTTNEIFYCTFRRLDPEENHTAELVIPELPLAHPPNER

SEQ ID NO: 533 - protein, 220 aa, synthetic construct
  REGION 1..220: note = PD-L1 ECD v64
FTVTVPKDLYVVEYGSNMTLECKFPVEKQLDLAALIVYWEKEGKDIIQFVHGEEDLKVQHSSYRQRARLLKDQLSLGNAALQITDVKLQDAGVYRCMISYGGADYKRITVKVNAPYNKINQRILVVDPVTSEHELTCQAEGYPKAEVIWTSSDHQVLSGKTTTTNSKREEKLFNVTSTLRINTTTNEIFYCTFRRLDPEENHTAELVIPELPLAHPPNER

SEQ ID NO: 534 - protein, 220 aa, synthetic construct
  REGION 1..220: note = PD-L1 ECD v65
FTVTVPKDLYVVEYGSNMTIECRFPVEKQLDLAALIVYWEMEDKTIIQFVHGEEDLKVQHSSYRQRARLLKDQLSLGIAALQITDVKLQDAGVYRCMISYGGADYKRITVKVNAPYNKINQRILVVDPVTSEHELTCQAEGYPKAEVIWTSSDHQVLSGKTTTTNSKREEKLFNVTSTLRINTTTNEIFYCTFRRLDPEENHTAELVIPELPLAHPPNER

SEQ ID NO: 535 - protein, 107 aa, synthetic construct
  REGION 1..107: note = PD-L1 IgV v1
PKDLYVVEYGSNMTIECKFPVENQLDLAALIVYWEVEDKTIIQFVNGEEDLEVQHSSYRQRARLLKDQLSLGNAALQITDVKLQDAGVYRCMISYGGADYKRITVKV

SEQ ID NO: 536 - protein, 107 aa, synthetic construct
  REGION 1..107: note = PD-L1 IgV v2
PKDLYVVEYGSNMTLECKFPVEKQLDLAALTVYWEMEDKDITQFVHGEEDLKVQHSSYRQRARLLKDQLSLGNAALQITDVKLQDAGVYRCMISYGGADYKRITVKV

SEQ ID NO: 537 - protein, 107 aa, synthetic construct
  REGION 1..107: note = PD-L1 IgV v3
PKDLYVVEYGSNMTLECKFPVEKQLDLAALIVYWEKEDENIIQFVHGEEDLKVQHSSYRQRARLLKDQLSLGNAALQITDVKLQDAGVYRCMISYGGADYKRITVKV

SEQ ID NO: 538 - protein, 107 aa, synthetic construct
  REGION 1..107: note = PD-L1 IgV v4
SKDLYVVEYGSNMTIECKFPVEKQLDLAALIVYWEMEDKTIIQFVHGEEDLKVQHSSYRQRARLLKDQLSLGIAALQTTDVKLQDAGVYRCMISYGGADYKRITVKV

SEQ ID NO: 539 - protein, 107 aa, synthetic construct
  REGION 1..107: note = PD-L1 IgV v5
PKDLYVVEYGSNMTIECKFPVEKQLDLAALIVYWEMEDKNIIQFVHGEEDLKVQHSSYRQRARLLKDQLSLGIAALQITDVKLQDAGVYRCMISYGGADYKRITVKV

SEQ ID NO: 540 - protein, 107 aa, synthetic construct
  REGION 1..107: note = PD-L1 IgV v6
PKDLYVVEYGSNMTIECKFPVEKQLDLAALIVYWEKEDKNIIQFVHGEEDLKVQHSSYRQRARLLKDQLSLGIAALQITDVKLQDAGVYRCMISYGGADYKRITVKV

SEQ ID NO: 541 - protein, 107 aa, synthetic construct
  REGION 1..107: note = PD-L1 IgV v7
PKDLYVVEYGSNMTIECKFPVEKQLDLAALIVYWEMEDKTIIQFVHGEEDLKVQHSSYRQRARLLKDQLSLGIAALQITDVKLQDAGVYRCMISYGGADYKRITVKV

SEQ ID NO: 542 - protein, 107 aa, synthetic construct
  REGION 1..107: note = PD-L1 IgV v8
PKDLYVVEYGSNMTLECKFPVEKQLDLAALIVYWEMEDKTIIQFVHGEEDLKVQHSSYRQRARLLKDQLSLGNAALQITDVKLQDAGVYRCMISYGGADYKRITVKV

SEQ ID NO: 543 - protein, 107 aa, synthetic construct
  REGION 1..107: note = PD-L1 IgV v9
PKDLYVVEYGSNMTIECKFPVEKQLDLAALIVYWEMEDKTIIQFVHGEEDLKVQHSSYRQRARLLKDQLSLGNAALQITDVKLQDAGVYRCMISYGGADYKRITVKV

SEQ ID NO: 544 - protein, 107 aa, synthetic construct
  REGION 1..107: note = PD-L1 IgV v10
PKDLYVVEYGSNMTIECKFPVEKQLDLAALIVYWEKEDKNIIQFVHGEEDLKVQHSSYRQRARLLKDQLSLGNAALQITDVKLQDAGVYRCMISYGGADYKRITVKV

SEQ ID NO: 545 - protein, 107 aa, synthetic construct
  REGION 1..107: note = PD-L1 IgV v11
PKDLYVVEYGSNMTLECKFPVEKQLDLAALTVYWEMEDKDIIQFVHGEEDLKVQHSSYRQRARLLKDQLSLGNAALQITDVKLQDAGVYRCMISYGGADYKRITVKV

SEQ ID NO: 546 - protein, 107 aa, synthetic construct
  REGION 1..107: note = PD-L1 IgV v12
PKDLYVVEYGSDMTIECKFPVEKQLDLAALIVYWEMEDKTIIQFAHGEEDLKVQHSSYRQRARLLKGQLSLGNAALQITDVKLQDAGVYRCMISYGGADYKRITVKV

SEQ ID NO: 547 - protein, 107 aa, synthetic construct
  REGION 1..107: note = PD-L1 IgV v13
PKDLYVVEYGSNMTLECKFPVEKQLDLAALIVYWEMEDKNIIQSVHGEEDLKVQHSSYRQRARLLKDQLSLGNAALQITDVKLQDAGVYRCMISYGGADYKRITVKV

SEQ ID NO: 548 - protein, 107 aa, synthetic construct
  REGION 1..107: note = PD-L1 IgV v14
PKDLYVVEYGSNMTIECKFPVEKQLDLAALIVYWEMEDKTIIQFAHGEEDLKVQHSSYRQRARLLKDQLSLGNAALQITDVKLQDAGVYRCMISYGGADYKRITVKV

SEQ ID NO: 549 - protein, 107 aa, synthetic construct
  REGION 1..107: note = PD-L1 IgV v15
PKDLYVVEYGSNMTLECKFPVEKQLDLAALIVYWEMEDKTIIQFVHGEEDLKVQHSSYRQRARLLKDQLSLGIAALQITDVKLQDAGVYRCMISYGGADYKRITVKV

SEQ ID NO: 550 - protein, 107 aa, synthetic construct
  REGION 1..107: note = PD-L1 IgV v16
PKDLYVVEYGSNMTLECKFPVEKQLDLAALIVYWEMEDKTIIQFAHGEEDLKVQHSSYRQRARLLKDQLSLGNAALQITDVKLQDAGVYRCMISYGGADYKRITVKV

SEQ ID NO: 551 - protein, 107 aa, synthetic construct
  REGION 1..107: note = PD-L1 IgV v17
PKDLYVVEYGSNMTIECKFPVEKQLDLAALIVYWEVEDKTIIQFVHGEEDLKVQHSSYRQRARLLKDQLSLGNAALQITDVKLQDAGVYRCMISYGGADYKRITVKV

SEQ ID NO: 552 - protein, 107 aa, synthetic construct
  REGION 1..107: note = PD-L1 IgV v18
PKDLYVVEYGSNMTIECKFPVEKQLDLAALIVYWEKEDKTIIQFVHGEEDLKVQHSSYRQRARLLKDQLSLGNAALQITDVKLQDAGVYRCMISYGGADYKRITVKV

SEQ ID NO: 553 - protein, 107 aa, synthetic construct
  REGION 1..107: note = PD-L1 IgV v19
PKDLYVVEYGSNMTIECKFPVEKQLDLDALIVYWEMEDKNIIQFVHGEEDLKVQHSSYRQRARLLKDQLPLGNAALQITEVKLQDAGVYRCMISYGGADYKRITVKV

SEQ ID NO: 554 - protein, 107 aa, synthetic construct
  REGION 1..107: note = PD-L1 IgV v20
PKDLYVVEYGSNITIECKFPVEKQLDLAALIVYWEKEGKNIIQFVRGEEDLKVQHSSYRQRARLLKDQLSLGIAALQITDVKLQDAGVYRCMISYGGADYKRITVKV

SEQ ID NO: 555 - protein, 107 aa, synthetic construct
  REGION 1..107: note = PD-L1 IgV v21
PKDLYEVEYGSNMTLECKFPVEKQLDLAALTVYWEMEDKDIIQFVHGEEDLKVQRSSYRQRARLLKDQLPLGNAALQITDVKLQDAGVYRCMISYGGADYKRITVKV

SEQ ID NO: 556 - protein, 107 aa, synthetic construct
  REGION 1..107: note = PD-L1 IgV v22
PKDLYVVEYGSNMTIECKFPVEKQLDLDALIVYWEMEDKNIIQFAHGEEDLKVQHSSYRQRARLLKDQLSLGNAALQITDVKLQDAGVYRCMISYGGADYKRITVKV

SEQ ID NO: 557 - protein, 107 aa, synthetic construct
  REGION 1..107: note = PD-L1 IgV v23
PKDLYVVEYGGNMTIECKFPVEKQLDLDALIVYWEMEDKNIIQFVHGEEDLKVQHSSYRQRARLLEDQLPLGNAALQITDVKLQDAGVYRCMISYGGADYKRITVKV

SEQ ID NO: 558 - protein, 107 aa, synthetic construct
  REGION 1..107: note = PD-L1 IgV v24
PKDLYVVEYGSNMTIECKFPVGKQLDLAALIVYWEMEDKTIIQFVHGEEDLKVQHSSYRQRARLLKDQLSLGNAALQITDVKLQDAGVYRCIISYGGADYKRITVKV

SEQ ID NO: 559 - protein, 107 aa, synthetic construct
  REGION 1..107: note = PD-L1 IgV v25
PKDLYVVEYGSNMTIECKFPVGKQLDLAALIVYWEMEDKTIIQFVHGEEDLRVQHSSYRQRARLLKDQLSLGNAALQITDVKLQDAGVYRCMISYGGADYKRITVKV

SEQ ID NO: 560 - protein, 107 aa, synthetic construct
  REGION 1..107: note = PD-L1 IgV v26
PKDLYVVEYGSNMTIECKFPVEKQLDLDALIVYWEMEDKNIIQFVHGVEDLKVQHSSYRQRARLLKDQLSLGNAALQITDVKLQDAGVYRCMISYGGADYKRITVKV

SEQ ID NO: 561 - protein, 107 aa, synthetic construct
  REGION 1..107: note = PD-L1 IgV v27
PKDLYVVEYGSNMTIECKFPVEKQLDLAALIVYWEMEGKDIIQFVHGEEDLKAQHSSYRQRARLLKDQLSLGNAALQITDVKLQDAGVYRCMISYGGADYKRITVKV

SEQ ID NO: 562 - protein, 107 aa, synthetic construct
  REGION 1..107: note = PD-L1 IgV v28
PKDLYVVEYGSNMTIECKFPVEKQLDLAALIVYWGMEVKTIIQFAHGEEDLKVQHSSYRQRARLLKDQLSLGNAALQITDVKLQDAGVYRCMISYGGADYKRITVKV

SEQ ID NO: 563 - protein, 107 aa, synthetic construct
  REGION 1..107: note = PD-L1 IgV v29
PKDLYVVESGSNMTIECKFPVEEQLDLAALIVYWEMEDKTIIQFVHGEEDLKVQHSSYRQRARLLKDQLSLGNAALQITDVKLQDAGVYRCMISYGGADYKRITVKV

SEQ ID NO: 564 - protein, 107 aa, synthetic construct
  REGION 1..107: note = PD-L1 IgV v30
PKDLYVVEYGSNMTIECKFPVEKQLDLDALIVYWEMEDKNIIQFVHGEEDLKVQHSSYRQRARLLKDQLSLGSAALQITDVKLQDAGVYRCMISYGGADYKRITVKV

SEQ ID NO: 565 - protein, 107 aa, synthetic construct
  REGION 1..107: note = PD-L1 IgV v31
PKDLYVVEYGSNMTIECKFPVEKQLDLDALIVYWEMEDKNIIQFVHGEEDLKVQHSSYRQRARLLKDQLSLGIAALQITDVKLQDAGVYRCMISYGGADYKRITVKV

SEQ ID NO: 566 - protein, 107 aa, synthetic construct
  REGION 1..107: note = PD-L1 IgV v32
PKDLYVVEYGSNMTIECKFPVEKQLDLDALIVYWEMEDKTIIQFVHGEEDLKVQHSSYRQRARLLKDQLSLGNAALQITDVKLQDAGVYRCMISYGGADYKRITVKV

SEQ ID NO: 567 - protein, 107 aa, synthetic construct
  REGION 1..107: note = PD-L1 IgV v33
PKDLYVVEYGSNMTIECKFPVEKQLDLDALIVYWEMEDKTIIQFVHGEEDLKVQHSSYRQRARLLKDQLSLGIAALQITDVKLQDAGVYRCMISYGGADYKRITVKV

SEQ ID NO: 568 - protein, 107 aa, synthetic construct
  REGION 1..107: note = PD-L1 IgV v34
PKDLYVVEYGSNMTIECKFPVGKQLDLAALIVYWEMEDKTIIQFAHGEEDLKVQHSSYRQRARLLKDQLSLGNAALQITDVKLQDAGVYRCMISYGGADYKRITVKV

SEQ ID NO: 569 - protein, 107 aa, synthetic construct
  REGION 1..107: note = PD-L1 IgV v35
PKDLYVVEYGSNMTIECKFPVEKQLDLAALIVYWEMEDKTIIQFAHGEEDLKVQHSSYRQRARLLKDQLSLGSAALQITDVKLQDAGVYRCMISYGGADYKRITVKV

SEQ ID NO: 570 - protein, 107 aa, synthetic construct
  REGION 1..107: note = PD-L1 IgV v36
PKDLYVVEYGSNMTLECKFPVEKQLDLAALIVYWEMEDKTIIQFVHGEEDLKVQHSSYRQRARLLKDQLSLGNAALQITDVKLQDAGVYRCMISYGGADYKRITMKV

SEQ ID NO: 571 - protein, 107 aa, synthetic construct
  REGION 1..107: note = PD-L1 IgV v37
PKDLYVVEYGSNMTLECKFPVEKQLDLAALTVYWEMEDKTIIQFAHGEEDLKVQHSSYRQRARLLKDQLSLGNAALQITDVKLQDAGVYRCMISYGGADYKRITVKV

SEQ ID NO: 572 - protein, 107 aa, synthetic construct
  REGION 1..107: note = PD-L1 IgV v38
PKDLYVVEYGSNMTIECKFPVEKQLDLAALIVYWEMEDKTIIQFVHGEEDLKVQHSSYRQRARLLKDQPPLGNAALQITDVKLQDAGVYRCMISYGGADYKRITVKV

SEQ ID NO: 573 - protein, 107 aa, synthetic construct
  REGION 1..107: note = PD-L1 IgV v39
PKDLYVVEYGSNMTIECKFPVEKQLDLAALIVYWEMEDKTIIQFVHGEEDLKVQHSSYRQRARLLKDQLPLGNAALQITDVKLQDAGVYRCMISYGGADYKRITVKV

SEQ ID NO: 574 - protein, 107 aa, synthetic construct
  REGION 1..107: note = PD-L1 IgV v40
PKDLYVVEYGSNMTIECKFPVEKQLDLAALIVYWEMEDKNIIQFVHGEEDLKVQHSSYRQRARLLKDQLPLGNAALQITDVKLQDAGVYRCMISYGGADYRRITVKV

SEQ ID NO: 575 - protein, 107 aa, synthetic construct
  REGION 1..107: note = PD-L1 IgV v41
PKDLYVVEYGSNMTIECKFPVEKQLDLAALIVYWEMEDKNIIQFVHGEEDLKVQHSSYRQRARLLKDQLPLGNAALQITDVKLQDAGVYRCMISYGGADYKRITVKV

SEQ ID NO: 576 - protein, 107 aa, synthetic construct
  REGION 1..107: note = PD-L1 IgV v42
PKDLYVVEYGSNMTIECKFPVEKQLDLDALIVYWEMEDKNIIQFVHGEEDLKVQHSSYRQRARLLKDQLPLGNAALQITDVKLQDAGVYRCVISYGGADYKRITVKV

SEQ ID NO: 577 - protein, 107 aa, synthetic construct
  REGION 1..107: note = PD-L1 IgV v43
PKDLYVVEYGSNMTIECKFPVEKQLDLDALIVYWEMEDKNIIQFVHGEEDLKVQHSSYRQRARLLKDQLPLGNAALQITDVKLQDAGVYRCMISYGGAGYKRITVKV

SEQ ID NO: 578 - protein, 107 aa, synthetic construct
  REGION 1..107: note = PD-L1 IgV v44
PKDLYVVEYGSNMTIECKFPVEKQLDLDALIVYWEMEDKNIIQFVHGEEDLKVQHSSYRQRARLLKDQLPLGNAALQITDVKLQDAGVYRCMISYGGADYKRITVKV

SEQ ID NO: 579 - protein, 107 aa, synthetic construct
  REGION 1..107: note = PD-L1 IgV v45
PKDLYVVEYGSNMTLECKFPVGKQLDLAALIVYWEMEDKTIIQFAHGEEDLKVQHSSYRQRARLLKDQLSLGNAALQITDVKLQDAGVYRCMISYGGADYKRITVKV

SEQ ID NO: 580 - protein, 107 aa, synthetic construct
  REGION 1..107: note = PD-L1 IgV v46
PKDLYVVEYGSNMTLECKFPVGKQLDLAALIVYWEMEGKDIIQFVHGEEDLKAQHSSYRQRARLLKDQLSLGIAALQITDVKLQDAGVYRCMISYGGADYKRITVKV

SEQ ID NO: 581 - protein, 107 aa, synthetic construct
  REGION 1..107: note = PD-L1 IgV v47
PKDLYVVEYGSNMTLECKFPVEKQLDLAALIVYWEMEGKDIIQFVHGEEDLKAQHSSYRQRARLLKDQLSLGIAALQITDVKLQDAGVYRCMISYGGADYKRITVKV

SEQ ID NO: 582 - protein, 107 aa, synthetic construct
  REGION 1..107: note = PD-L1 IgV v48
PKDLYVVEYGSNMTLECKFPVEKQLDLDALIVYWEMEGKDIIQFVHGEEDLKAQHSSYRQRARLLKDQLSLGIAALQITDVKLQDAGVYRCMISYGGADYKRITVKV

SEQ ID NO: 583 - protein, 107 aa, synthetic construct
  REGION 1..107: note = PD-L1 IgV v49
PKDLYVVEYGSNMTLECKFPVEKQLDLAALIVYWEMEGKDIIQFVHGEEDLKVQHSSYRQRARLLKDQLSLGIAALQITDVKLQDAGVYRCMISYGGADYKRITVKV

SEQ ID NO: 584 - protein, 107 aa, synthetic construct
  REGION 1..107: note = PD-L1 IgV v50
PKDLYVVEYGSNMTIECKFPVGKQLDLAALIVYWEMEDKTIIQFAHGEEDLKVQHSSYRQRARLLKDQLSLGIAALQITDVKLQDAGVYRCMISYGGADYKRITVKV

SEQ ID NO: 585 - protein, 107 aa, synthetic construct
  REGION 1..107: note = PD-L1 IgV v51
PKDLYVVEYGSNMTIECKFPVEKQLDLAALIVYWEMEDKTIIQFAHGEEDLKVQHSSYRQRARLLKDQLSLGIAALQITDVKLQDAGVYRCMISYGGADYKRITVKV

SEQ ID NO: 586 - protein, 107 aa, synthetic construct
  REGION 1..107: note = PD-L1 IgV v52
PKDLYAVEYGSNMTLECKFPVGKQLDLAALIVYWEMEGKDIIQFVYGEEDLKVQHSSYRQRARLLKDQLSLGNAALQITDVKLQDAGVYRCMIGYGGADYKRITVKV

SEQ ID NO: 587 - protein, 107 aa, synthetic construct
  REGION 1..107: note = PD-L1 IgV v53
PKDLYVVEYGSNMTLECKFPVGKQLDLAALIVYWEMEGKTIIQFAHGEEDLKVQHSSYRQRARLLKDQLSLGNAALQITDVKLQDAGVYRCMISYGGADYKRITVKV

SEQ ID NO: 588 - protein, 107 aa, synthetic construct
  REGION 1..107: note = PD-L1 IgV v54
PKDLYVVEYGSNMTLECKFPVEEQLDLAALIVYWEMEGKDIIQFVHGEEDLKAQHSSYRQRARLLKDQLSLGNAALQITDVKLRDAGVYRCMISYGGADYKRITVKV

SEQ ID NO: 589 - protein, 107 aa, synthetic construct; identical to SEQ ID NO: 545
  REGION 1..107: note = PD-L1 IgV v55

SEQ ID NO: 590 - protein, 107 aa, synthetic construct
  REGION 1..107: note = PD-L1 IgV v56
PKDLYVVEYGSNMTLECKFPVEEQLDLAALIVYWEMEGKDIIQFVHGGEDLKAQHSSYRQRARLLKDQLSLGIAALQITDVKLQDAGVYRCMISYGGADYKRITVKV

SEQ ID NO: 591 - protein, 107 aa, synthetic construct
  REGION 1..107: note = PD-L1 IgV v57
PKDLYVVEYGSNMTIECKFPVEKQLDLDALIVYWEMEGKDIIQFVHGEEDLKAQHSSYRQRARLLKDQLPLGNAALQITDVKLQDAGVYRCMISYGGADYKRITVKV

SEQ ID NO: 592 - protein, 107 aa, synthetic construct
  REGION 1..107: note = PD-L1 IgV v58
PKDLYVVEYGSNMTIECRFPVEKQLDLAALIVYWEMEGKDIIQFVHGEEDLKVQHSSYRQRARLLKDQLSLGNAALQITDVKLQDAGVYRCMISYGGADYKRITVKV

SEQ ID NO: 593 - protein, 107 aa, synthetic construct
  REGION 1..107: note = PD-L1 IgV v59
PKDLYVVEYGSNMTLECKFPVEKQLDLAALIVYWEMEGKDIIQFVHGEEDLKAQHSSYRQRARLLKDQLSLGIAALQITDVKLQGAGVYRCMISYDGADYKRITVKV

SEQ ID NO: 594 - protein, 108 aa, synthetic construct
  REGION 1..108: note = PD-L1 IgV v60
PKDLYVVEYGSNMTIECKFPVEKQLDLAALIVYWEMEGKDIIQFVHGEEDQKAQHSSYRQRARLLKDQLSLGNAALQITDVKLQDAGVYRCMISYGGGADYKRITVKV

SEQ ID NO: 595 - protein, 107 aa, synthetic construct
  REGION 1..107: note = PD-L1 IgV v61
PKDLYVVEYGSNMTLECEFPVEKQLDLAALIVYWEMEGKDIIQFVHGEEDLKAQHSSYRQRARLLKDQLSLGIAALQITDVKLQDAGVYRCMISYGGADYKRITVKV

SEQ ID NO: 596 - protein, 107 aa, synthetic construct
  REGION 1..107: note = PD-L1 IgV v62
PKDLYVVEYGSNMTLECEFPVEKQLDLAALIVYWEMEGKDIIQFAHGEEDLKVQHSSYRQRARLLKDQLSLGIAALQITDVKLQDAGVYRCMISYGGADYKRITVKV

SEQ ID NO: 597 - protein, 107 aa, synthetic construct
  REGION 1..107: note = PD-L1 IgV v63
PKDLYVVEYGSNMIIECKFPVGKQLDLAALIVYWEMEDKIIIQFAHGEEDLKVQHSSYRQRARLLKDQLSLGIAALQITDVKLQDAGVYRCKISYGGADYKRITVKV

SEQ ID NO: 598 - protein, 107 aa, synthetic construct
  REGION 1..107: note = PD-L1 IgV v64
PKDLYVVEYGSNMTLECKFPVEKQLDLAALIVYWEKEGKDIIQFVHGEEDLKVQHSSYRQRARLLKDQLSLGNAALQITDVKLQDAGVYRCMISYGGADYKRITVKV

SEQ ID NO: 599 - protein, 107 aa, synthetic construct
  REGION 1..107: note = PD-L1 IgV v65
PKDLYVVEYGSNMTIECRFPVEKQLDLAALIVYWEMEDKTIIQFVHGEEDLKVQHSSYRQRARLLKDQLSLGIAALQITDVKLQDAGVYRCMISYGGADYKRITVKV

SEQ ID NO: 600 - protein, 114 aa, synthetic construct
  REGION 1..114: note = PD-L1 IgV v1
FTVTVPKDLYVVEYGSNMTIECKFPVENQLDLAALIVYWEVEDKTIIQFVNGEEDLEVQHSSYRQRARLLKDQLSLGNAALQITDVKLQDAGVYRCMISYGGADYKRITVKVNA

SEQ ID NO: 601 - protein, 114 aa, synthetic construct
  REGION 1..114: note = PD-L1 IgV v2
FTVTVPKDLYVVEYGSNMTLECKFPVEKQLDLAALTVYWEMEDKDITQFVHGEEDLKVQHSSYRQRARLLKDQLSLGNAALQITDVKLQDAGVYRCMISYGGADYKRITVKVNA

SEQ ID NO: 602 - protein, 114 aa, synthetic construct
  REGION 1..114: note = PD-L1 IgV v3
FTVTVPKDLYVVEYGSNMTLECKFPVEKQLDLAALIVYWEKEDENIIQFVHGEEDLKVQHSSYRQRARLLKDQLSLGNAALQITDVKLQDAGVYRCMISYGGADYKRITVKVNA

SEQ ID NO: 603 - protein, 114 aa, synthetic construct
  REGION 1..114: note = PD-L1 IgV v4
FTVTVSKDLYVVEYGSNMTIECKFPVEKQLDLAALIVYWEMEDKTIIQFVHGEEDLKVQHSSYRQRARLLKDQLSLGIAALQTTDVKLQDAGVYRCMISYGGADYKRITVKVNA

SEQ ID NO: 604 - protein, 114 aa, synthetic construct
  REGION 1..114: note = PD-L1 IgV v5
FTVTVPKDLYVVEYGSNMTIECKFPVEKQLDLAALIVYWEMEDKNIIQFVHGEEDLKVQHSSYRQRARLLKDQLSLGIAALQITDVKLQDAGVYRCMISYGGADYKRITVKVNA

SEQ ID NO: 605 - protein, 114 aa, synthetic construct
  REGION 1..114: note = PD-L1 IgV v6
FTVTVPKDLYVVEYGSNMTIECKFPVEKQLDLAALIVYWEKEDKNIIQFVHGEEDLKVQHSSYRQRARLLKDQLSLGIAALQITDVKLQDAGVYRCMISYGGADYKRITVKVNA

SEQ ID NO: 606 - protein, 114 aa, synthetic construct
  REGION 1..114: note = PD-L1 IgV v7
FTVTVPKDLYVVEYGSNMTIECKFPVEKQLDLAALIVYWEMEDKTIIQFVHGEEDLKVQHSSYRQRARLLKDQLSLGIAALQITDVKLQDAGVYRCMISYGGADYKRITVKVNA

SEQ ID NO: 607 - protein, 114 aa, synthetic construct
  REGION 1..114: note = PD-L1 IgV v8
FTVTVPKDLYVVEYGSNMTLECKFPVEKQLDLAALIVYWEMEDKTIIQFVHGEEDLKVQHSSYRQRARLLKDQLSLGNAALQITDVKLQDAGVYRCMISYGGADYKRITVKVNA

SEQ ID NO: 608 - protein, 114 aa, synthetic construct
  REGION 1..114: note = PD-L1 IgV v9
FTVTVPKDLYVVEYGSNMTIECKFPVEKQLDLAALIVYWEMEDKTIIQFVHGEEDLKVQHSSYRQRARLLKDQLSLGNAALQITDVKLQDAGVYRCMISYGGADYKRITVKVNA

SEQ ID NO: 609 - protein, 114 aa, synthetic construct
  REGION 1..114: note = PD-L1 IgV v10
FTVTVPKDLYVVEYGSNMTIECKFPVEKQLDLAALIVYWEKEDKNIIQFVHGEEDLKVQHSSYRQRARLLKDQLSLGNAALQITDVKLQDAGVYRCMISYGGADYKRITVKVNA

SEQ ID NO: 610 - protein, 114 aa, synthetic construct
  REGION 1..114: note = PD-L1 IgV v11
FTVTVPKDLYVVEYGSNMTLECKFPVEKQLDLAALTVYWEMEDKDIIQFVHGEEDLKVQHSSYRQRARLLKDQLSLGNAALQITDVKLQDAGVYRCMISYGGADYKRITVKVNA

SEQ ID NO: 611 - protein, 114 aa, synthetic construct
  REGION 1..114: note = PD-L1 IgV v12
FTVTVPKDLYVVEYGSDMTIECKFPVEKQLDLAALIVYWEMEDKTIIQFAHGEEDLKVQHSSYRQRARLLKGQLSLGNAALQITDVKLQDAGVYRCMISYGGADYKRITVKVNA

SEQ ID NO: 612 - protein, 114 aa, synthetic construct
  REGION 1..114: note = PD-L1 IgV v13
FTVTVPKDLYVVEYGSNMTLECKFPVEKQLDLAALIVYWEMEDKNIIQSVHGEEDLKVQHSSYRQRARLLKDQLSLGNAALQITDVKLQDAGVYRCMISYGGADYKRITVKVNA

SEQ ID NO: 613 - protein, 114 aa, synthetic construct
  REGION 1..114: note = PD-L1 IgV v14
FTVTVPKDLYVVEYGSNMTIECKFPVEKQLDLAALIVYWEMEDKTIIQFAHGEEDLKVQHSSYRQRARLLKDQLSLGNAALQITDVKLQDAGVYRCMISYGGADYKRITVKVNA

SEQ ID NO: 614 - protein, 114 aa, synthetic construct
  REGION 1..114: note = PD-L1 IgV v15
FTVTVPKDLYVVEYGSNMTLECKFPVEKQLDLAALIVYWEMEDKTIIQFVHGEEDLKVQHSSYRQRARLLKDQLSLGIAALQITDVKLQDAGVYRCMISYGGADYKRITVKVNA

SEQ ID NO: 615 - protein, 114 aa, synthetic construct
  REGION 1..114: note = PD-L1 IgV v16
FTVTVPKDLYVVEYGSNMTLECKFPVEKQLDLAALIVYWEMEDKTIIQFAHGEEDLKVQHSSYRQRARLLKDQLSLGNAALQITDVKLQDAGVYRCMISYGGADYKRITVKVNA

SEQ ID NO: 616 - protein, 114 aa, synthetic construct
  REGION 1..114: note = PD-L1 IgV v17
FTVTVPKDLYVVEYGSNMTIECKFPVEKQLDLAALIVYWEVEDKTIIQFVHGEEDLKVQHSSYRQRARLLKDQLSLGNAALQITDVKLQDAGVYRCMISYGGADYKRITVKVNA

SEQ ID NO: 617 - protein, 114 aa, synthetic construct
  REGION 1..114: note = PD-L1 IgV v18
FTVTVPKDLYVVEYGSNMTIECKFPVEKQLDLAALIVYWEKEDKTIIQFVHGEEDLKVQHSSYRQRARLLKDQLSLGNAALQITDVKLQDAGVYRCMISYGGADYKRITVKVNA

SEQ ID NO: 618 - protein, 114 aa, synthetic construct
  REGION 1..114: note = PD-L1 IgV v19
FTVTVPKDLYVVEYGSNMTIECKFPVEKQLDLDALIVYWEMEDKNIIQFVHGEEDLKVQHSSYRQRARLLKDQLPLGNAALQITEVKLQDAGVYRCMISYGGADYKRITVKVNA

SEQ ID NO: 619 - protein, 114 aa, synthetic construct
  REGION 1..114: note = PD-L1 IgV v20
FTVTVPKDLYVVEYGSNITIECKFPVEKQLDLAALIVYWEKEGKNIIQFVRGEEDLKVQHSSYRQRARLLKDQLSLGIAALQITDVKLQDAGVYRCMISYGGADYKRITVKVNA

SEQ ID NO: 620 - protein, 114 aa, synthetic construct
  REGION 1..114: note = PD-L1 IgV v21
FTVTVPKDLYEVEYGSNMTLECKFPVEKQLDLAALTVYWEMEDKDIIQFVHGEEDLKVQRSSYRQRARLLKDQLPLGNAALQITDVKLQDAGVYRCMISYGGADYKRITVKVNA

SEQ ID NO: 621 - protein, 114 aa, synthetic construct
  REGION 1..114: note = PD-L1 IgV v22
FTVTVPKDLYVVEYGSNMTIECKFPVEKQLDLDALIVYWEMEDKNIIQFAHGEEDLKVQHSSYRQRARLLKDQLSLGNAALQITDVKLQDAGVYRCMISYGGADYKRITVKVNA

SEQ ID NO: 622 - protein, 114 aa, synthetic construct
  REGION 1..114: note = PD-L1 IgV v23
FTVTVPKDLYVVEYGGNMTIECKFPVEKQLDLDALIVYWEMEDKNIIQFVHGEEDLKVQHSSYRQRARLLEDQLPLGNAALQITDVKLQDAGVYRCMISYGGADYKRITVKVNA

SEQ ID NO: 623 - protein, 114 aa, synthetic construct
  REGION 1..114: note = PD-L1 IgV v24
FTVTVPKDLYVVEYGSNMTIECKFPVGKQLDLAALIVYWEMEDKTIIQFVHGEEDLKVQHSSYRQRARLLKDQLSLGNAALQITDVKLQDAGVYRCIISYGGADYKRITVKVNA

SEQ ID NO: 624 - protein, 114 aa, synthetic construct
  REGION 1..114: note = PD-L1 IgV v25
FTVTVPKDLYVVEYGSNMTIECKFPVGKQLDLAALIVYWEMEDKTIIQFVHGEEDLRVQHSSYRQRARLLKDQLSLGNAALQITDVKLQDAGVYRCMISYGGADYKRITVKVNA

SEQ ID NO: 625 - protein, 114 aa, synthetic construct
  REGION 1..114: note = PD-L1 IgV v26
FTVTVPKDLYVVEYGSNMTIECKFPVEKQLDLDALIVYWEMEDKNIIQFVHGVEDLKVQHSSYRQRARLLKDQLSLGNAALQITDVKLQDAGVYRCMISYGGADYKRITVKVNA

SEQ ID NO: 626 - protein, 114 aa, synthetic construct
  REGION 1..114: note = PD-L1 IgV v27
FTVTVPKDLYVVEYGSNMTIECKFPVEKQLDLAALIVYWEMEGKDIIQFVHGEEDLKAQHSSYRQRARLLKDQLSLGNAALQITDVKLQDAGVYRCMISYGGADYKRITVKVNA

SEQ ID NO: 627 - protein, 114 aa, synthetic construct
  REGION 1..114: note = PD-L1 IgV v28
FTVTVPKDLYVVEYGSNMTIECKFPVEKQLDLAALIVYWGMEVKTIIQFAHGEEDLKVQHSSYRQRARLLKDQLSLGNAALQITDVKLQDAGVYRCMISYGGADYKRITVKVNA

SEQ ID NO: 628 - protein, 114 aa, synthetic construct
  REGION 1..114: note = PD-L1 IgV v29
FTVTVPKDLYVVESGSNMTIECKFPVEEQLDLAALIVYWEMEDKTIIQFVHGEEDLKVQHSSYRQRARLLKDQLSLGNAALQITDVKLQDAGVYRCMISYGGADYKRITVKVNA

SEQ ID NO: 629 - protein, 114 aa, synthetic construct
  REGION 1..114: note = PD-L1 IgV v30
FTVTVPKDLYVVEYGSNMTIECKFPVEKQLDLDALIVYWEMEDKNIIQFVHGEEDLKVQHSSYRQRARLLKDQLSLGSAALQITDVKLQDAGVYRCMISYGGADYKRITVKVNA

SEQ ID NO: 630 - protein, 114 aa, synthetic construct
  REGION 1..114: note = PD-L1 IgV v31
FTVTVPKDLYVVEYGSNMTIECKFPVEKQLDLDALIVYWEMEDKNIIQFVHGEEDLKVQHSSYRQRARLLKDQLSLGIAALQITDVKLQDAGVYRCMISYGGADYKRITVKVNA

SEQ ID NO: 631 - protein, 114 aa, synthetic construct
  REGION 1..114: note = PD-L1 IgV v32
FTVTVPKDLYVVEYGSNMTIECKFPVEKQLDLDALIVYWEMEDKTIIQFVHGEEDLKVQHSSYRQRARLLKDQLSLGNAALQITDVKLQDAGVYRCMISYGGADYKRITVKVNA

SEQ ID NO: 632 - protein, 114 aa, synthetic construct
  REGION 1..114: note = PD-L1 IgV v33
FTVTVPKDLYVVEYGSNMTIECKFPVEKQLDLDALIVYWEMEDKTIIQFVHGEEDLKVQHSSYRQRARLLKDQLSLGIAALQITDVKLQDAGVYRCMISYGGADYKRITVKVNA

SEQ ID NO: 633 - protein, 114 aa, synthetic construct
  REGION 1..114: note = PD-L1 IgV v34
FTVTVPKDLYVVEYGSNMTIECKFPVGKQLDLAALIVYWEMEDKTIIQFAHGEEDLKVQHSSYRQRARLLKDQLSLGNAALQITDVKLQDAGVYRCMISYGGADYKRITVKVNA

SEQ ID NO: 634 - protein, 114 aa, synthetic construct
  REGION 1..114: note = PD-L1 IgV v35
FTVTVPKDLYVVEYGSNMTIECKFPVEKQLDLAALIVYWEMEDKTIIQFAHGEEDLKVQHSSYRQRARLLKDQLSLGSAALQITDVKLQDAGVYRCMISYGGADYKRITVKVNA

SEQ ID NO: 635 - protein, 114 aa, synthetic construct
  REGION 1..114: note = PD-L1 IgV v36
FTVTVPKDLYVVEYGSNMTLECKFPVEKQLDLAALIVYWEMEDKTIIQFVHGEEDLKVQHSSYRQRARLLKDQLSLGNAALQITDVKLQDAGVYRCMISYGGADYKRITMKVNA

SEQ ID NO: 636 - protein, 114 aa, synthetic construct
  REGION 1..114: note = PD-L1 IgV v37
FTVTVPKDLYVVEYGSNMTLECKFPVEKQLDLAALTVYWEMEDKTIIQFAHGEEDLKVQHSSYRQRARLLKDQLSLGNAALQITDVKLQDAGVYRCMISYGGADYKRITVKVNA

SEQ ID NO: 637 - protein, 114 aa, synthetic construct
  REGION 1..114: note = PD-L1 IgV v38
FTVTVPKDLYVVEYGSNMTIECKFPVEKQLDLAALIVYWEMEDKTIIQFVHGEEDLKVQHSSYRQRARLLKDQPPLGNAALQITDVKLQDAGVYRCMISYGGADYKRITVKVNA

SEQ ID NO: 638 - protein, 114 aa, synthetic construct
  REGION 1..114: note = PD-L1 IgV v39
FTVTVPKDLYVVEYGSNMTIECKFPVEKQLDLAALIVYWEMEDKTIIQFVHGEEDLKVQHSSYRQRARLLKDQLPLGNAALQITDVKLQDAGVYRCMISYGGADYKRITVKVNA

SEQ ID NO: 639 - protein, 114 aa, synthetic construct
  REGION 1..114: note = PD-L1 IgV v40
FTVTVPKDLYVVEYGSNMTIECKFPVEKQLDLAALIVYWEMEDKNIIQFVHGEEDLKVQHSSYRQRARLLKDQLPLGNAALQITDVKLQDAGVYRCMISYGGADYRRITVKVNA

SEQ ID NO: 640 - protein, 114 aa, synthetic construct
  REGION 1..114: note = PD-L1 IgV v41
FTVTVPKDLYVVEYGSNMTIECKFPVEKQLDLAALIVYWEMEDKNIIQFVHGEEDLKVQHSSYRQRARLLKDQLPLGNAALQITDVKLQDAGVYRCMISYGGADYKRITVKVNA

SEQ ID NO: 641 - protein, 114 aa, synthetic construct
  REGION 1..114: note = PD-L1 IgV v42
FTVTVPKDLYVVEYGSNMTIECKFPVEKQLDLDALIVYWEMEDKNIIQFVHGEEDLKVQHSSYRQRARLLKDQLPLGNAALQITDVKLQDAGVYRCVISYGGADYKRITVKVNA

SEQ ID NO: 642 - protein, 114 aa, synthetic construct
  REGION 1..114: note = PD-L1 IgV v43
FTVTVPKDLYVVEYGSNMTIECKFPVEKQLDLDALIVYWEMEDKNIIQFVHGEEDLKVQHSSYRQRARLLKDQLPLGNAALQITDVKLQDAGVYRCMISYGGAGYKRITVKVNA

SEQ ID NO: 643 - protein, 114 aa, synthetic construct
  REGION 1..114: note = PD-L1 IgV v44
FTVTVPKDLYVVEYGSNMTIECKFPVEKQLDLDALIVYWEMEDKNIIQFVHGEEDLKVQHSSYRQRARLLKDQLPLGNAALQITDVKLQDAGVYRCMISYGGADYKRITVKVNA

SEQ ID NO: 644 - protein, 114 aa, synthetic construct
  REGION 1..114: note = PD-L1 IgV v45
FTVTVPKDLYVVEYGSNMTLECKFPVGKQLDLAALIVYWEMEDKTIIQFAHGEEDLKVQHSSYRQRARLLKDQLSLGNAALQITDVKLQDAGVYRCMISYGGADYKRITVKVNA

SEQ ID NO: 645 - protein, 114 aa, synthetic construct
  REGION 1..114: note = PD-L1 IgV v46
FTVTVPKDLYVVEYGSNMTLECKFPVGKQLDLAALIVYWEMEGKDIIQFVHGEEDLKAQHSSYRQRARLLKDQLSLGIAALQITDVKLQDAGVYRCMISYGGADYKRITVKVNA

SEQ ID NO: 646 - protein, 114 aa, synthetic construct
  REGION 1..114: note = PD-L1 IgV v47
FTVTVPKDLYVVEYGSNMTLECKFPVEKQLDLAALIVYWEMEGKDIIQFVHGEEDLKAQHSSYRQRARLLKDQLSLGIAALQITDVKLQDAGVYRCMISYGGADYKRITVKVNA

SEQ ID NO: 647 - protein, 114 aa, synthetic construct
  REGION 1..114: note = PD-L1 IgV v48
FTVTVPKDLYVVEYGSNMTLECKFPVEKQLDLDALIVYWEMEGKDIIQFVHGEEDLKAQHSSYRQRARLLKDQLSLGIAALQITDVKLQDAGVYRCMISYGGADYKRITVKVNA

SEQ ID NO: 648 - protein, 114 aa, synthetic construct
  REGION 1..114: note = PD-L1 IgV v49
FTVTVPKDLYVVEYGSNMTLECKFPVEKQLDLAALIVYWEMEGKDIIQFVHGEEDLKVQHSSYRQRARLLKDQLSLGIAALQITDVKLQDAGVYRCMISYGGADYKRITVKVNA

SEQ ID NO: 649 - protein, 114 aa, synthetic construct
  REGION 1..114: note = PD-L1 IgV v50
FTVTVPKDLYVVEYGSNMTIECKFPVGKQLDLAALIVYWEMEDKTIIQFAHGEEDLKVQHSSYRQRARLLKDQLSLGIAALQITDVKLQDAGVYRCMISYGGADYKRITVKVNA

SEQ ID NO: 650 - protein, 114 aa, synthetic construct
  REGION 1..114: note = PD-L1 IgV v51
FTVTVPKDLYVVEYGSNMTIECKFPVEKQLDLAALIVYWEMEDKTIIQFAHGEEDLKVQHSSYRQRARLLKDQLSLGIAALQITDVKLQDAGVYRCMISYGGADYKRITVKVNA

SEQ ID NO: 651 - protein, 114 aa, synthetic construct
  REGION 1..114: note = PD-L1 IgV v52
FTVTVPKDLYAVEYGSNMTLECKFPVGKQLDLAALIVYWEMEGKDIIQFVYGEEDLKVQHSSYRQRARLLKDQLSLGNAALQITDVKLQDAGVYRCMIGYGGADYKRITVKVNA

SEQ ID NO: 652 - protein, 114 aa, synthetic construct
  REGION 1..114: note = PD-L1 IgV v53
FTVTVPKDLYVVEYGSNMTLECKFPVGKQLDLAALIVYWEMEGKTIIQFAHGEEDLKVQHSSYRQRARLLKDQLSLGNAALQITDVKLQDAGVYRCMISYGGADYKRITVKVNA

SEQ ID NO: 653 - protein, 114 aa, synthetic construct
  REGION 1..114: note = PD-L1 IgV v54
FTVTVPKDLYVVEYGSNMTLECKFPVEEQLDLAALIVYWEMEGKDIIQFVHGEEDLKAQHSSYRQRARLLKDQLSLGNAALQITDVKLRDAGVYRCMISYGGADYKRITVKVNA

SEQ ID NO: 654 - protein, 114 aa, synthetic construct; identical to SEQ ID NO: 610
  REGION 1..114: note = PD-L1 IgV v55

SEQ ID NO: 655 - protein, 114 aa, synthetic construct
  REGION 1..114: note = PD-L1 IgV v56
FTVTVPKDLYVVEYGSNMTLECKFPVEEQLDLAALIVYWEMEGKDIIQFVHGGEDLKAQHSSYRQRARLLKDQLSLGIAALQITDVKLQDAGVYRCMISYGGADYKRITVKVNA

SEQ ID NO: 656 - protein, 114 aa, synthetic construct
  REGION 1..114: note = PD-L1 IgV v57
FTVTVPKDLYVVEYGSNMTIECKFPVEKQLDLDALIVYWEMEGKDIIQFVHGEEDLKAQHSSYRQRARLLKDQLPLGNAALQITDVKLQDAGVYRCMISYGGADYKRITVKVNA

SEQ ID NO: 657 - protein, 114 aa, synthetic construct
  REGION 1..114: note = PD-L1 IgV v58
FTVTVPKDLYVVEYGSNMTIECRFPVEKQLDLAALIVYWEMEGKDIIQFVHGEEDLKVQHSSYRQRARLLKDQLSLGNAALQITDVKLQDAGVYRCMISYGGADYKRITVKVNA

SEQ ID NO: 658 - protein, 114 aa, synthetic construct
  REGION 1..114: note = PD-L1 IgV v59
FTVTVPKDLYVVEYGSNMTLECKFPVEKQLDLAALIVYWEMEGKDIIQFVHGEEDLKAQHSSYRQRARLLKDQLSLGIAALQITDVKLQGAGVYRCMISYDGADYKRITVKVNA

SEQ ID NO: 659 - protein, 115 aa, synthetic construct
  REGION 1..115: note = PD-L1 IgV v60
FTVTVPKDLYVVEYGSNMTIECKFPVEKQLDLAALIVYWEMEGKDIIQFVHGEEDQKAQHSSYRQRARLLKDQLSLGNAALQITDVKLQDAGVYRCMISYGGGADYKRITVKVNA

SEQ ID NO: 660 - protein, 114 aa, synthetic construct
  REGION 1..114: note = PD-L1 IgV v61
FTVTVPKDLYVVEYGSNMTLECEFPVEKQLDLAALIVYWEMEGKDIIQFVHGEEDLKAQHSSYRQRARLLKDQLSLGIAALQITDVKLQDAGVYRCMISYGGADYKRITVKVNA

SEQ ID NO: 661 - protein, 114 aa, synthetic construct
  REGION 1..114: note = PD-L1 IgV v62
FTVTVPKDLYVVEYGSNMTLECEFPVEKQLDLAALIVYWEMEGKDIIQFAHGEEDLKVQHSSYRQRARLLKDQLSLGIAALQITDVKLQDAGVYRCMISYGGADYKRITVKVNA

SEQ ID NO: 662 - protein, 114 aa, synthetic construct
  REGION 1..114: note = PD-L1 IgV v63
FTVTVPKDLYVVEYGSNMIIECKFPVGKQLDLAALIVYWEMEDKIIIQFAHGEEDLKVQHSSYRQRARLLKDQLSLGIAALQITDVKLQDAGVYRCKISYGGADYKRITVKVNA

SEQ ID NO: 663 - protein, 114 aa, synthetic construct
  REGION 1..114: note = PD-L1 IgV v64
FTVTVPKDLYVVEYGSNMTLECKFPVEKQLDLAALIVYWEKEGKDIIQFVHGEEDLKVQHSSYRQRARLLKDQLSLGNAALQITDVKLQDAGVYRCMISYGGADYKRITVKVNA

SEQ ID NO: 664 - protein, 114 aa, synthetic construct
  REGION 1..114: note = PD-L1 IgV v65
FTVTVPKDLYVVEYGSNMTIECRFPVEKQLDLAALIVYWEMEDKTIIQFVHGEEDLKVQHSSYRQRARLLKDQLSLGIAALQITDVKLQDAGVYRCMISYGGADYKRITVKVNA

SEQ ID NO: 665 - protein, 114 aa, Homo sapiens
  REGION 1..114: note = MISC_FEATURE - PD-L1 IgV wildtype
FTVTVPKDLYVVEYGSNMTIECKFPVEKQLDLAALIVYWEMEDKNIIQFVHGEEDLKVQHSSYRQRARLLKDQLSLGNAALQITDVKLQDAGVYRCMISYGGADYKRITVKVNA

SEQ ID NO: 666 - protein, 98 aa, synthetic construct
  REGION 1..98: note = PD-L2 IgV
FTVTVPKELYIIEHGSNVTLECNFDTGSHVNLGAITASLQKVENDTSPHRERATLLEEQLPLGKASFHIPQVQVRDEGQYQCIIIYGVAWDYKYLTLK

SEQ ID NO: 667 - protein, 201 aa, synthetic construct
  REGION 1..201: note = PD-L2 ECD v1
LFTVTVPKELYIIEQGSNVTLECNFDTGSHVNLGAITASLQKVENDTSPHRERATLLEEQLPLGKASFHIPQVQVRDEGQYQCIIIYGVAWDYKYLTLKVKASYRKINTHILKVPETDEVELTCQATGYPLAEVSWPNVSVPANTSHSRTPEGLYQVTSVLRLKPPPGRNFSCVFWNTHVRELTLASIDLQSQMEPRTHPT

SEQ ID NO: 668 - protein, 201 aa, synthetic construct
  REGION 1..201: note = PD-L2 ECD v2
LFTVTVPKELYIIEHGSNVTLECDFDTGSHVNLGAITASLQKVENDTSPHRERATLLEEQLPLGKASFHIPQVQVRDEGQYQCIIIYGVAWDYKYLTLKVKASYRKINTHILKVPETDEVELTCQATGYPLAEVSWPNVSVPANTSHSRTPEGLYQVTSVLRLKPPPGRNFSCVFWNTHVRELTLASIDLQSQMEPRTHPT

SEQ ID NO: 669 - protein, 201 aa, synthetic construct
  REGION 1..201: note = PD-L2 ECD v3
LFTVTVPKELYIIEHGSNVTLECNFDTGSHVNLGAITASLQKVDNDTSPHRERATLLEEQLPLGKASFHIPQVQVRDEGQYQCIIIYGVAWDYKYLTLKVKASYRKINTHILKVPETDEVELTCQATGYPLAEVSWPNVSVPANTSHSRTPEGLYQVTSVLRLKPPPGRNFSCVFWNTHVRELTLASIDLQSQMEPRTHPT

SEQ ID NO: 670 - protein, 201 aa, synthetic construct
  REGION 1..201: note = PD-L2 ECD v4
LFTVTVPKELYIIEHGSNVTLECNFDTGSHVNLGAITASLQKVENDTSPHRERATLLEEQLPLGKASFHIPQVQVRDEGQYQCIIIYGDAWDYKYLTLKVKASYRKINTHILKVPETDEVELTCQATGYPLAEVSWPNVSVPANTSHSRTPEGLYQVTSVLRLKPPPGRNFSCVFWNTHVRELTLASIDLQSQMEPRTHPT

SEQ ID NO: 671 - protein, 201 aa, synthetic construct
  REGION 1..201: note = PD-L2 ECD v5
LFTVTVPKELYIIEHGSNVTLECNFDTGSHVNLGAITASLQKVENDTSPHRERATLLEEQLPLGKASFHIPQVQVRDEGQYRCIIIYGDAWDYKYLTLKVKASYRKINTHILKVPETDEVELTCQATGYPLAEVSWPNVSVPANTSHSRTPEGLYQVTSVLRLKPPPGRNFSCVFWNTHVRELTLASIDLQSQMEPRTHPT

SEQ ID NO: 672 - protein, 201 aa, synthetic construct
  REGION 1..201: note = PD-L2 ECD v6
LFTVTVPKELYIIEHGSNVTLECNFDTGSHVNLGAITASLQKVENDTSPHRERATLLEGQLPLGKASFHIPQVQVRDEGQYRCIIIYGVAWDYKYLTLKVKASYRKINTHILKVPETDEVELTCQATGYPLAEVSWPNVSVPANTSHSRTPEGLYQVTSVLRLKPPPGRNFSCVFWNTHVRELTLASIDLQSQMEPRTHPT

SEQ ID NO: 673 - protein, 201 aa, synthetic construct
  REGION 1..201: note = PD-L2 ECD v7
LFTVTVPKELYIIEHGSNVTLECNFDTGSHVNLGAITAILQKVENDTSPHRERATLLEEQLPLGKASFHIPQVQVRDEGQYQCIIIYGDAWDYKYLTLKVKASYRKINTHILKVPETDEVELTCQATGYPLAEVSWPNVSVPANTSHSRTPEGLYQVTSVLRLKPPPGRNFSCVFWNTHVRELTLASIDLQSQMEPRTHPT

SEQ ID NO: 674 - protein, 201 aa, synthetic construct
  REGION 1..201: note = PD-L2 ECD v8
LFTVTVPKELYIIEHGSNVTLECNFDTGSHVNLGAITASLQKVENDTSPHRERATLLEEQLPLGKALFHIPQVQVRDEGQYQCIIIYGDAWDYKYLTLKVKASYRKINTHILKVPETDEVELTCQATGYPLAEVSWPNVSVPANTSHSRTPEGLYQVTSVLRLKPPPGRNFSCVFWNTHVRELTLASIDLQSQMEPRTHPT

SEQ ID NO: 675 - protein, 201 aa, synthetic construct
  REGION 1..201: note = PD-L2 ECD v9
LFTVTVPKELYIIEHGSNVTLECNFDTGSHVNLGAITASLQKVENDTSPHRERATLLEEQLPLGKALFHIPQVQVRDEGQYQCIFIYGVAWDYKYLTLKVKASYRKINTHILKVPETDEVELTCQATGYPLAEVSWPNVSVPANTSHSRTPEGLYQVTSVLRLKPPPGRNFSCVFWNTHVRELTLASIDLQSQMEPRTHPT

SEQ ID NO: 676 - protein, 201 aa, synthetic construct
  REGION 1..201: note = PD-L2 ECD v10
LFTVTVPKELYIIEHGSNVTLECNFDTGSHVNLGAITASLQKVENDTSPHRERATLLEEQLPLGKALFHIPQVQVRDEGQYQCIITYGVAWDYKYLTLKVKASYRKINTHILKVPETDEVELTCQATGYPLAEVSWPNVSVPANTSHSRTPEGLYQVTSVLRLKPPPGRNFSCVFWNTHVRELTLASIDLQSQMEPRTHPT

SEQ ID NO: 677 - protein, 201 aa, synthetic construct
  REGION 1..201: note = PD-L2 ECD v11
LFTVTVPKELYIIEQGSNVTLECNFDTGSHVNLGAITASLQKVENDTSPHRERATLLEEQLPLGRASFHIPQVQVRDEGQYQCIIIYGVAWDYKYLTLKVKASYRKINTHILKVPETDEVELTCQATGYPLAEVSWPNVSVPANTSHSRTPEGLYQVTSVLRLKPPPGRNFSCVFWNTHVRELTLASIDLQSQMEPRTHPT

SEQ ID NO: 678 - protein, 201 aa, synthetic construct
  REGION 1..201: note = PD-L2 ECD v12
LFTVTVPKELYIIEQGSNVTLECNFDTGSHVNLGAITASLQKVENDTSPHRERATLLEEQLPLGKASFHIPHVQVRDEGQYQCIIIYGDAWDYKYLTLKVKASYRKINTHILKVPETDEVELTCQATGYPLAEVSWPNVSVPANTSHSRTPEGLYQVTSVLRLKPPPGRNFSCVFWNTHVRELTLASIDLQSQMEPRTHPT

SEQ ID NO: 679 - protein, 201 aa, synthetic construct
  REGION 1..201: note = PD-L2 ECD v13
LFTVTVPKELYIIEQGSNVTLECNFDTGSHVNLGAITASLQKVENDTSPHRERATLLEEQLPLGKALFHIPQVQVGDEGQYQCIIIYGVAWDYKYLTLKVKASYRKINTHILKVPETDEVELTCQATGYPLAEVSWPNVSVPANTSHSRTPEGLYQVTSVLRLKPPPGRNFSCVFWNTHVRELTLASIDLQSQMEPRTHPT

SEQ ID NO: 680 - protein, 201 aa, synthetic construct
  REGION 1..201: note = PD-L2 ECD v14
LFTVTVPKELYIIEQGSNVTLECNFDTGSHVNLGAITASLQKVENDTSPHRERATLLEEQLPLGKASFHIPQVQVGDEGQYQCIFIYGVAWDYKYLTLKVKASYRKINTHILKVPETDEVELTCQATGYPLAEVSWPNVSVPANTSHSRTPEGLYQVTSVLRLKPPPGRNFSCVFWNTHVRELTLASIDLQSQMEPRTHPT

SEQ ID NO: 681 - protein, 201 aa, synthetic construct
  REGION 1..201: note = PD-L2 ECD v15
LFTVTVPKELYIIEQGSNVTLECNFDTGSHVNLGAITASLQKVENDASPHRERATLLEEQLPLGKASFHIPQVQVRDEGQYRCIIIYGVAWDYKYLTLKVKASYRKINTHILKVPETDEVELTCQATGYPLAEVSWPNVSVPANTSHSRTPEGLYQVTSVLRLKPPPGRNFSCVFWNTHVRELTLASIDLQSQMEPRTHPT

SEQ ID NO: 682 - protein, 201 aa, synthetic construct
  REGION 1..201: note = PD-L2 ECD v16
LFTVTVPKELYIIEQGSNVTLECNFDTGSHVNLGAITASLQKVENDTSPHRERATLLEEQLPLGKASFHIPQVQVRDEGQYRCIIIYGDAWDYKYLTLKVKASYRKINTHILKVPETDEVELTCQATGYPLAEVSWPNVSVPANTSHSRTPEGLYQVTSVLRLKPPPGRNFSCVFWNTHVRELTLASIDLQSQMEPRTHPT

SEQ ID NO: 683 - protein, 201 aa, synthetic construct
  REGION 1..201: note = PD-L2 ECD v17
LFTVTVPKELYIIEQGSNVTLESNFDTGSHVNLGAITASLQKVENDTSPHRERATLLEEQLPLGKASFHIPQVQVRDEGQYQCIITYGVAWDYKYLTLKVKASYRKINTHILKVPETDEVELTCQATGYPLAEVSWPNVSVPANTSHSRTPEGLYQVTSVLRLKPPPGRNFSCVFWNTHVRELTLASIDLQSQMEPRTHPT

SEQ ID NO: 684 - protein, 201 aa, synthetic construct
  REGION 1..201: note = PD-L2 ECD v18
LFTVTVPKELYIIEQGSNVTLECNFDTGSHVNLGAITAILQKVENDTSPHRERATLLEEQLPLGKASFHIPQVQVRDEGQYQCIITYGVAWDYKYLTLKVKASYRKINTHILKVPETDEVELTCQATGYPLAEVSWPNVSVPANTSHSRTPEGLYQVTSVLRLKPPPGRNFSCVFWNTHVRELTLASIDLQSQMEPRTHPT

SEQ ID NO: 685 - protein, 201 aa, synthetic construct; identical to SEQ ID NO: 680
  REGION 1..201: note = PD-L2 ECD v19

SEQ ID NO: 686 - protein, 201 aa, synthetic construct
  REGION 1..201: note = PD-L2 ECD v20
LFTVTVPKELYIIEHGSNVTLECNFDTGSHVNLGAITASLQKVDNDTSPHRERATLLEEQLPLGKASFHIPQVQVRDEGQYQCIIIYGDARDYKYLTLKVKASYRKINTHILKVPETDEVELTCQATGYPLAEVSWPNVSVPANTSHSRTPEGLYQVTSVLRLKPPPGRNFSCVFWNTHVRELTLASIDLQSQMEPRTHPT

SEQ ID NO: 687 - protein, 201 aa, synthetic construct
  REGION 1..201: note = PD-L2 ECD v21
LFTVTVPKELYIVEHGSNVTLECNFDTGSHVNLGAITASLQKVENDTSPHRERATLLEEQLPLGKALFHIPQVQVRDEGQYQCIIIYGDAWDYKYLTLKVKASYRKINTHILKVPETDEVELTCQATGYPLAEVSWPNVSVPANTSHSRTPEGLYQVTSVLRLKPPPGRNFSCVFWNTHVRELTLASIDLQSQMEPRTHPT

SEQ ID NO: 688 - protein, 201 aa, synthetic construct
  REGION 1..201: note = PD-L2 ECD v22
LFTVTVPKELYIIEQGSNVTLECNFDTGSHVNLGAITASLQKVENDTSPHRERATLLEEQLPLGKALFHIPQVQVRDEGQYQCIITYGVAWDYKYLTLKVKASYRKINTHILKVPETDEVELTCQATGYPLAEVSWPNVSVPANTSHSRTPEGLYQVTSVLRLKPPPGRNFSCVFWNTHVRELTLASIDLQSQMEPRTHPT

SEQ ID NO: 689 - protein, 201 aa, synthetic construct
  REGION 1..201: note = PD-L2 ECD v23
LFTVTVPKELYIVEQGSNVTLECNFDTGSHVNLGAITASLQKVENDTSPHRERATLLEEQLPLGKALFHIPQVQVRDEGQYQCIITYGVAWDYKYLTLKVKASYRKINTHILKVPETDEVELTCQATGYPLAEVSWPNVSVPANTSHSRTPEGLYQVTSVLRLKPPPGRNFSCVFWNTHVRELTLASIDLQSQMEPRTHPT

SEQ ID NO: 690 - protein, 201 aa, synthetic construct
  REGION 1..201: note = PD-L2 ECD v24
LFTVTVPKELYIVEQGSNVTLECNFDTGSHVNLGAITASLQKVDNDTSPHRERATLLEEQLPLGKASFHIPQVQVRDEGQYQCIIIYGDAWDYKYLTLKVKASYRKINTHILKVPETDEVELTCQATGYPLAEVSWPNVSVPANTSHSRTPEGLYQVTSVLRLKPPPGRNFSCVFWNTHVRELTLASIDLQSQMEPRTHPT

SEQ ID NO: 691 - protein, 201 aa, synthetic construct
  REGION 1..201: note = PD-L2 ECD v25
LFTVTVPKELYIVEHGSNVTLECNFDTGSHVNLGAITAILQKVDNDTSPHRERATLLEEQLPLGKASFHIPQVQVRDEGQYRCIIIYGDAWDYKYLTLKVKASYRKINTHILKVPETDEVELTCQATGYPLAEVSWPNVSVPANTSHSRTPEGLYQVTSVLRLKPPPGRNFSCVFWNTHVRELTLASIDLQSQMEPRTHPT

SEQ ID NO: 692 - protein, 201 aa, synthetic construct
  REGION 1..201: note = PD-L2 ECD v26
LFTVTVPKELYIVEHGSNVTLECNFDTGSHVNLGAITASLQKVDNDTSPHRERATLLEEQLPLGKASFHIPQVQVRDEGQYRCIIIYGDAWDYKYLTLKVKASYRKINTHILKVPETDEVELTCQATGYPLAEVSWPNVSVPANTSHSRTPEGLYQVTSVLRLKPPPGRNFSCVFWNTHVRELTLASIDLQSQMEPRTHPT

SEQ ID NO: 693 - protein, 201 aa, synthetic construct
  REGION 1..201: note = PD-L2 ECD v27
LFTVTVPKELYIVEHGSNVTLECNFDTGSHVNLGAITASLQKVENDTSPHRERATLLEEQLPLGKASFHIPHVQVGDEGQYQCIITYGVAWDYKYLTLKVKASYRKINTHILKVPETDEVELTCQATGYPLAEVSWPNVSVPANTSHSRTPEGLYQVTSVLRLKPPPGRNFSCVFWNTHVRELTLASIDLQSQMEPRTHPT

SEQ ID NO: 694 - protein, 201 aa, synthetic construct
  REGION 1..201: note = PD-L2 ECD v28
LFTVTVPKELYIVEQGSNVTLECNFDTGSHVNLGAITASLQKVENDTSPHRERATLLEEQLPLGKASFHIPQVQVGDEGQYQCIFIYGVAWDYKYLTLKVKASYRKINTHILKVPETDEVELTCQATGYPLAEVSWPNVSVPANTSHSRTPEGLYQVTSVLRLKPPPGRNFSCVFWNTHVRELTLASIDLQSQMEPRTHPT

SEQ ID NO: 695 - protein, 201 aa, synthetic construct
  REGION 1..201: note = PD-L2 ECD v29
LFTVTVPKELYIIEQGSNVTLECNFDTGSHVNLGAITAILQKVENDTSPHRERATLLEEQLPLGKASFHIPQVQVGDEGQYQCIIIYGDAWDYKYLTLKVKASYRKINTHILKVPETDEVELTCQATGYPLAEVSWPNVSVPANTSHSRTPEGLYQVTSVLRLKPPPGRNFSCVFWNTHVRELTLASIDLQSQMEPRTHPT

SEQ ID NO: 696 - protein, 201 aa, synthetic construct
  REGION 1..201: note = PD-L2 ECD v30
LFTVTVPKELYIIEQGSNVTLECNFDTGSHVNLGAITASLQKVENDTSPHRERATLLEEQLPLGKALFHIPQVQVGDEGQYQCIFIYGVAWDYKYLTLKVKASYRKINTHILKVPETDEVELTCQATGYPLAEVSWPNVSVPANTSHSRTPEGLYQVTSVLRLKPPPGRNFSCVFWNTHVRELTLASIDLQSQMEPRTHPT

SEQ ID NO: 697 - protein, 201 aa, synthetic construct
  REGION 1..201: note = PD-L2 ECD v31
LFTVTVPKELYIIEQGSNVTLECNFDTGSHVNLGAITASLQKVENDASPHRERATLLEEQLPLGKASFHIPHVQVGDEGQYQCIITYGVAWDYKYLTLKVKASYRKINTHILKVPETDEVELTCQATGYPLAEVSWPNVSVPANTSHSRTPEGLYQVTSVLRLKPPPGRNFSCVFWNTHVRELTLASIDLQSQMEPRTHPT

SEQ ID NO: 698 - protein, 201 aa, synthetic construct
  REGION 1..201: note = PD-L2 ECD v32
LFTVTVPKELYIIEQGSNVTLECNFDTGSHVNLGAITASLQKVENDASPHRERATLLEEQLPLGKASFHIPHVQVGDEGQYQCIIIYGVAWDYKYLTLKVKASYRKINTHILKVPETDEVELTCQATGYPLAEVSWPNVSVPANTSHSRTPEGLYQVTSVLRLKPPPGRNFSCVFWNTHVRELTLASIDLQSQMEPRTHPT

SEQ ID NO: 699 - protein, 201 aa, synthetic construct
  REGION 1..201: note = PD-L2 ECD v33
LFTVTVPKELYIVEQGSNVTLECNFDTGSHVNLGAITASLQKVENDASPHRERATLLEEQLPLGKASFHIPHVQVGDEGQYQCIIIYGVAWDYKYLTLKVKASYRKINTHILKVPETDEVELTCQATGYPLAEVSWPNVSVPANTSHSRTPEGLYQVTSVLRLKPPPGRNFSCVFWNTHVRELTLASIDLQSQMEPRTHPT

SEQ ID NO: 700 - protein, 201 aa, synthetic construct
  REGION 1..201: note = PD-L2 ECD v34
LFTVTVPKELYIIEQGSNVTLECNFDTGSHVNLGAITASLQKVDNDTSPHRERATLLEEQLPLGKASFHIPQVQVGDEGQYQCIFIYGVAWDYKYLTLKVKASYRKINTHILKVPETDEVELTCQATGYPLAEVSWPNVSVPANTSHSRTPEGLYQVTSVLRLKPPPGRNFSCVFWNTHVRELTLASIDLQSQMEPRTHPT

SEQ ID NO: 701 - protein, 201 aa, synthetic construct
  REGION 1..201: note = PD-L2 ECD v35
LFTVTVPKELYIIEQGSNVTLECNFDTGSHVNLGAITAILQKVENDTSPHRERATLLEEQLPLGKALFHIPQVQVRDEGQYQCIIIYGDAWDYKYLTLKVKASYRKINTHILKVPETDEVELTCQATGYPLAEVSWPNVSVPANTSHSRTPEGLYQVTSVLRLKPPPGRNFSCVFWNTHVRELTLASIDLQSQMEPRTHPT

SEQ ID NO: 702 - protein, 201 aa, synthetic construct
  REGION 1..201: note = PD-L2 ECD v36
LFTVTVPKELYIIEQGSNVTLECNFDTGSHVDLGAITASLQKVENDTSPHRERATLLEEQLPLGKALFHIPQVQVRDEGQYQCIIIYGDAWDYKYLTLKVKASYRKINTHILKVPETDEVELTCQATGYPLAEVSWPNVSVPANTSHSRTPEGLYQVTSVLRLKPPPGRNFSCVFWNTHVRELTLASIDLQSQMEPRTHPT

SEQ ID NO: 703 - protein, 201 aa, synthetic construct
  REGION 1..201: note = PD-L2 ECD v37
LFTVTVPKELYIIEHGSNVTLECNFDTGSHVDLGAITASLQKVENDTSPHRERATLLEEQLPLGKALFHIPQVQVRDEGQYQCIIIYGDAWDYKYLTLKVKASYRKINTHILKVPETDEVELTCQATGYPLAEVSWPNVSVPANTSHSRTPEGLYQVTSVLRLKPPPGRNFSCVFWNTHVRELTLASIDLQSQMEPRTHPT

SEQ ID NO: 704 - protein, 201 aa, synthetic construct
  REGION 1..201: note = PD-L2 ECD v38
LFTVTVPKELYIIEQGSNVTLECNFDTGSHVNLGAITASLQKVENDTSPHRERATLLEEQLPLGKALFHIPHVQVGDEGQYQCIIIYGDAWDYKYLTLKVKASYRKINTHILKVPETDEVELTCQATGYPLAEVSWPNVSVPANTSHSRTPEGLYQVTSVLRLKPPPGRNFSCVFWNTHVRELTLASIDLQSQMEPRTHPT

SEQ ID NO: 705 - protein, 201 aa, synthetic construct
  REGION 1..201: note = PD-L2 ECD v39
LFTVTVPKELYIIEQGSNVTLECNFDTGSHVNLGAITASLQKVENDTSPHRERATLLEEQLPLGKASFHIPHVRVGDEGQYQCIITYGVAWDYKYLTLKVKASYRKINTHILKVPETDEVELTCQATGYPLAEVSWPNVSVPANTSHSRTPEGLYQVTSVLRLKPPPGRNFSCVFWNTHVRELTLASIDLQSQMEPRTHPT

SEQ ID NO: 706 - protein, 201 aa, synthetic construct
  REGION 1..201: note = PD-L2 ECD v40
LFTVTVPKELYIIEHGSNVTLECNFDTVSHVNLGAITASLQKVENDTSPHRERATLLEEQLPLGKASFHIPHVQVGDEGQYQCIITYGVAWDYKYLTLKVKASYRKINTHILKVPETDEVELTCQATGYPLAEVSWPNVSVPANTSHSRTPEGLYQVTSVLRLKPPPGRNFSCVFWNTHVRELTLASIDLQSQMEPRTHPT

SEQ ID NO: 707 - protein, 201 aa, synthetic construct
  REGION 1..201: note = PD-L2 ECD v41
LFTVTVPKELYIVEQGSNVTLECNFDTGSHVNLGAITAILQKVDNDTSPHRERATLLEEQLPLGKALFHIPQVQVRDEGQYQCIIIYGVAWDYKYLTLKVKASYRKINTHILKVPETDEVELTCQATGYPLAEVSWPNVSVPANTSHSRTPEGLYQVTSVLRLKPPPGRNFSCVFWNTHVRELTLASIDLQSQMEPRTHPT

SEQ ID NO: 708 - protein, 201 aa, synthetic construct
  REGION 1..201: note = PD-L2 ECD v42
LFTVTVPKELYIIEHGSNVTLECNFDTGSHVNLGAITASLQKVDNDTSPHRERATLLEEQLPLGKALFHIPHVQVRDEGQYRCIIIYGDAWDYKYLTLKVKASYRKINTHILKVPETDEVELTCQATGYPLAEVSWPNVSVPANTSHSRTPEGLYQVTSVLRLKPPPGRNFSCVFWNTHVRELTLASIDLQSQMEPRTHPT

SEQ ID NO: 709 - protein, 201 aa, synthetic construct
  REGION 1..201: note = PD-L2 ECD v43
LFTVTVPKELYIIEQGSNVTLECNFDTGSHVNLGAITASLQKVENDTSPHRERATLLEEQLPLGKASFHIPQVQVRDEGQYQCIIIYGDAWDYKYLTLKVKASYRKINTHILKVPETDEVELTCQATGYPLAEVSWPNVSVPANTSHSRTPEGLYQVTSVLRLKPPPGRNFSCVFWNTHVRELTLASIDLQSQMEPRTHPT

SEQ ID NO: 710 - protein, 201 aa, synthetic construct
  REGION 1..201: note = PD-L2 ECD v44
LFTVTVPKELYIIEQGSNVTLECNFDTGSHVNLGAITASLQKVENDASPHRERATLLEEQLPLGKASFHIPQVQVRDEGQYQCIIIYGVAWDYKYLTLKVKASYRKINTHILKVPETDEVELTCQATGYPLAEVSWPNVSVPANTSHSRTPEGLYQVTSVLRLKPPPGRNFSCVFWNTHVRELTLASIDLQSQMEPRTHPT

SEQ ID NO: 711 - protein, 201 aa, synthetic construct
  REGION 1..201: note = PD-L2 ECD v45
LFTVTVPKELYIVEQGSNVTLECNFDTGSHVNLGAITASLQKVENDTSPHRERATLLEEQLPLGKASFHIPQVQVRDEGQYRCIIIYGVAWDYKYLTLKVKASYRKINTHILKVPETDEVELTCQATGYPLAEVSWPNVSVPANTSHSRTPEGLYQVTSVLRLKPPPGRNFSCVFWNTHVRELTLASIDLQSQMEPRTHPT

SEQ ID NO: 712 - protein, 201 aa, synthetic construct
  REGION 1..201: note = PD-L2 ECD v46
LFTVTVPKELYIVEQGSNVTLECNFDTGSHVNLGAITASLQKVENDTSPHRERATLLEEQLPLGKASFHIPQVQVRDEGQYQCIIIYGDAWDYKYLTLKVKASYRKINTHILKVPETDEVELTCQATGYPLAEVSWPNVSVPANTSHSRTPEGLYQVTSVLRLKPPPGRNFSCVFWNTHVRELTLASIDLQSQMEPRTHPT

SEQ ID NO: 713 - protein, 201 aa, synthetic construct
  REGION 1..201: note = PD-L2 ECD v47
LFTVTVPKELYIVEHGSNVTLECNFDTGSHVNLGAITASLQKVENDTSPHRERATLLEEQLPLGKALFHIPQVQVRDEGQYRCIIIYGDAWDYKYLTLKVKASYRKINTHILKVPETDEVELTCQATGYPLAEVSWPNVSVPANTSHSRTPEGLYQVTSVLRLKPPPGRNFSCVFWNTHVRELTLASIDLQSQMEPRTHPT

SEQ ID NO: 714 - protein, 201 aa, synthetic construct
  REGION 1..201: note = PD-L2 ECD v48
LFTVTVPKELYIVEQGSNVTLECNFDTGSHVNLGAITASLQKVENDTSPHRERATLLEEQLPLGKASFHIPQVQVRDEGQYRCIIIYGDAWDYKYLTLKVKASYRKINTHILKVPETDEVELTCQATGYPLAEVSWPNVSVPANTSHSRTPEGLYQVTSVLRLKPPPGRNFSCVFWNTHVRELTLASIDLQSQMEPRTHPT

SEQ ID NO: 715 - protein, 201 aa, synthetic construct
  REGION 1..201: note = PD-L2 ECD v49
LFTVTVPKELYIIEQGSNVTLECNFDTGSHMNLGAITASLQKVENDTSPHRERATLLEEQLPLGKALFHIPQVQVRDEGQYRCIIIYGDAWDYKYLTLKVKASYRKINTHILKVPETDEVELTCQATGYPLAEVSWPNVSVPANTSHSRTPEGLYQVTSVLRLKPPPGRNFSCVFWNTHVRELTLASIDLQSQMEPRTHPT

SEQ ID NO: 716 - protein, 201 aa, synthetic construct
  REGION 1..201: note = PD-L2 ECD v50
LFTVTVPKELYIVEQGSNVTLECNFDTGSHVNLGAITASLQKVENDASPHRERATLLEEQLPLGKASFHIPQVQVRDEGQYRCIIIYGVAWDYKYLTLKVKASYRKINTHILKVPETDEVELTCQATGYPLAEVSWPNVSVPANTSHSRTPEGLYQVTSVLRLKPPPGRNFSCVFWNTHVRELTLASIDLQSQMEPRTHPT

SEQ ID NO: 717 - protein, 201 aa, synthetic construct
  REGION 1..201: note = PD-L2 ECD v51
LFTVTVPKELYIVEQGSNVTLECNFDTGSHANLGAITASLQKVESDTSPHRERATLLEEQLPLGKASFHIPQVQVRDEGQYRCIIIYGDAWDYKYLTLKVKASYRKINTHILKVPETDEVELTCQATGYPLAEVSWPNVSVPANTSHSRTPEGLYQVTSVLRLKPPPGRNFSCVFWNTHVRELTLASIDLQSQMEPRTHPT

SEQ ID NO: 718 - protein, 201 aa, synthetic construct
  REGION 1..201: note = PD-L2 ECD v52
  VARIANT 65: note = Xaa = unknown
LFTVTVPKELYIVEHGSNVALECNFDTGSHVNLGAITASLQKVENDASPHRERATLLEEQLPLGXASFHIPQVQVRDEGQYRCIIIYGDAWDYKYLTLKVKASYRKINTHILKVPETDEVELTCQATGYPLAEVSWPNVSVPANTSHSRTPEGLYQVTSVLRLKPPPGRNFSCVFWNTHVRELTLASIDLQSQMEPRTHPT

SEQ ID NO: 719 - protein, 201 aa, synthetic construct
  REGION 1..201: note = PD-L2 ECD v53
LFTVTVPKELYIIEQGSNVTLECNFDTGSHVNLGAITASLQKVENDASPHRERATLLEEQLPLGKASFLIPQVQVRDEGQYRCIIIYGDAWDYKYLTLKVKASYRKINTHILKVPETDEVELTCQATGYPLAEVSWPNVSVPANTSHSRTPEGLYQVTSVLRLKPPPGRNFSCVFWNTHVRELTLASIDLQSQMEPRTHPT

SEQ ID NO: 720 - protein, 201 aa, synthetic construct
  REGION 1..201: note = PD-L2 ECD v54
LFTVTVPKELYIVEQGSNVTLECNFDTGSHVNLGAITASLQKVENDASPHRERATLLEEQLPLGKASFLIPQVQVGDEGQYQCIIIYGDAWDYKYLTLKVKASYRKINTHILKVPETDEVELTCQATGYPLAEVSWPNVSVPANTSHSRTPEGLYQVTSVLRLKPPPGRNFSCVFWNTHVRELTLASIDLQSQMEPRTHPT

SEQ ID NO: 721 - protein, 201 aa, synthetic construct
  REGION 1..201: note = PD-L2 ECD v55
LFTVTVPKELYVVEQGSNVTLECNFDTGSHVNLGAITASLQKVENDASPHRERATLLEEQLPLGKASFHIPQVQVRDEGQYRCIIIYGDAWDYKYLTLKVKASYRKINTHILKVPETDEVELTCQATGYPLAEVSWPNVSVPANTSHSRTPEGLYQVTSVLRLKPPPGRNFSCVFWNTHVRELTLASIDLQSQMEPRTHPT

SEQ ID NO: 722 - protein, 201 aa, synthetic construct
  REGION 1..201: note = PD-L2 ECD v56
LFTVTVPKELYIVEQGSNVTLECNFDTGSHVNLGAITASLQKVENDTSPHRERATLLEEQLPLGKASFHIPQVQVGNEGQYRCIIIYGDAWDYKYLTLKVKASYRKINTHILKVPETDEVELTCQATGYPLAEVSWPNVSVPANTSHSRTPEGLYQVTSVLRLKPPPGRNFSCVFWNTHVRELTLASIDLQSQMEPRTHPT

SEQ ID NO: 723 - protein, 201 aa, synthetic construct
  REGION 1..201: note = PD-L2 ECD v57
LFTVTVPKELYIVEQGSNVTLECNFDTGSHVNLGAITASLQKVENDASPHRERATLLEEQLPLGKASFHIPQVQVGDEGQYQCIIIYGDAWDYKYLTLKVKASYRKINTHILKVPETDEVELTCQATGYPLAEVSWPNVSVPANTSHSRTPEGLYQVTSVLRLKPPPGRNFSCVFWNTHVRELTLASIDLQSQMEPRTHPT

SEQ ID NO: 724 - protein, 201 aa, synthetic construct
  REGION 1..201: note = PD-L2 ECD v58
LFTVTVPKELYIVEQGSNVTLECNFDTGSHVNLGAITASLQKVENDASPHRERATLLEEQLPLGKASFHIPQVQVRDEGQYRCIIIYGDAWDYKYLTLKVKASYRKINTHILKVPETDEVELTCQATGYPLAEVSWPNVSVPANTSHSRTPEGLYQVTSVLRLKPPPGRNFSCVFWNTHVRELTLASIDLQSQMEPRTHPT

SEQ ID NO: 725 - protein, 201 aa, synthetic construct
  REGION 1..201: note = PD-L2 ECD v59
LFTVTVPKELYIVEQGSNVTLECDFDTGSHVNLGAITASLQKVENDTSPHRERATLLEEQLPLGKASFHIPQVQVRDEGQYRCIIIYGDAWDYKYLTLKVKASYRKINTHILKVPETDEVELTCQATGYPLAEVSWPNVSVPANTSHSRTPEGLYQVTSVLRLKPPPGRNFSCVFWNTHVRELTLASIDLQSQMEPRTHPT

SEQ ID NO: 726 - protein, 102 aa, Homo sapiens
  REGION 1..102: note = MISC_FEATURE - PD-L2 IgV wildtype
LFTVTVPKELYIIEHGSNVTLECNFDTGSHVNLGAITASLQKVENDTSPHRERATLLEEQLPLGKASFHIPQVQVRDEGQYQCIIIYGVAWDYKYLTLKVKA

SEQ ID NO: 727 - protein, 201 aa, synthetic construct
  REGION 1..201: note = PD-L2 ECD v61
LFTVTVPKELYIVEQGSNVTLECNFDTGSHVNLGAVTASLQKVENDASPHRERATLLEEQLPLGKALFHIPQVQVRDEGQYQCIIIYGDAWDYKYLTLKVKASYRKINTHILKVPETDEVELTCQATGYPLAEVSWPNVSVPANTSHSRTPEGLYQVTSVLRLKPPPGRNFSCVFWNTHVRELTLASIDLQSQMEPRTHPT

SEQ ID NO: 728 - protein, 201 aa, synthetic construct
  REGION 1..201: note = PD-L2 ECD v62
LFTVTVPKELYIIEQGSNVTLECNFDTGSHVNLGAITASLQKVENDASPHRERATLLEEQLPLGRALFHIPQVQVRDEGQYRCIIIYGDAWDYKYLTLKVKASYRKINTHILKVPETDEVELTCQATGYPLAEVSWPNVSVPANTSHSRTPEGLYQVTSVLRLKPPPGRNFSCVFWNTHVRELTLASIDLQSQMEPRTHPT

SEQ ID NO: 729 - protein, 201 aa, synthetic construct
  REGION 1..201: note = PD-L2 ECD v63
LFTVTVPKELYIIEQGSNVTLECNFDTGSHVNPGAITASLQKVENDASPHRERATLLEEQLPLGKALFHISQVQVRDEGQYQCIIIYGDAWDYKYLTLKVKASYRKINTHILKVPETDEVELTCQATGYPLAEVSWPNVSVPANTSHSRTPEGLYQVTSVLRLKPPPGRNFSCVFWNTHVRELTLASIDLQSQMEPRTHPT

SEQ ID NO: 730 - protein, 201 aa, synthetic construct
  REGION 1..201: note = PD-L2 ECD v64
LFTVTVPKELYIVEQGSNVTLECNFDTGSHVNLGAITASLQKVENDTSPHRERATLLEEQLPLGKASFHIPHVQVGDEGQYQCIITYGVAWDYKYLTLKVKASYRKINTHILKVPETDEVELTCQATGYPLAEVSWPNVSVPANTSHSRTPEGLYQVTSVLRLKPPPGRNFSCVFWNTHVRELTLASIDLQSQMEPRTHPT

SEQ ID NO: 731 - protein, 201 aa, synthetic construct
  REGION 1..201: note = PD-L2 ECD v65
LFTVTVPKELYIIEQGSNVTLECNFDTGSHVNLGAITASLQKVENDASPHRERATLLEEQLPLGKALFHIPQVQVRDEGQYRCIIIYGDAWDYKYLTLKVKASYRKINTHILKVPETDEVELTCQATGYPLAEVSWPNVSVPANTSHSRTPEGLYQVTSVLRLKPPPGRNFSCVFWNTHVRELTLASIDLQSQMEPRTHPT

SEQ ID NO: 732 - protein, 201 aa, synthetic construct
  REGION 1..201: note = PD-L2 ECD v66
LLTVTVPKELYIIEQGSNVTLECNFDTGSHVNLGAITASLQKVENEASPHRERATLLEEQLPLGKASFHIPHVQVGDEGQYRCIIIYGDAWDYKYLTLKVKASYRKINTHILKVPETDEVELTCQATGYPLAEVSWPNVSVPANTSHSRTPEGLYQVTSVLRLKPPPGRNFSCVFWNTHVRELTLASIDLQSQMEPRTHPT

SEQ ID NO: 733 - protein, 201 aa, synthetic construct
  REGION 1..201: note = PD-L2 ECD v67
LFTVTVPKELYIVEQGSNVTLECNFDTGSHVNFGAITASLQKVENDASPHRERATLLEEQLPLGKASFHIPQVQVRDEGQYRCIIIYGDAWDYKYLTLKVKASYRKINTHILKVPETDEVELTCQATGYPLAEVSWPNVSVPANTSHSRTPEGLYQVTSVLRLKPPPGRNFSCVFWNTHVRELTLASIDLQSQMEPRTHPT

SEQ ID NO: 734 - protein, 201 aa, synthetic construct
  REGION 1..201: note = PD-L2 ECD v68
LFTVTVPKELYIVEQGSNVTLECNFDTGSHVNLGAITASLQKVENDASPHRERATLLGEQLPLGKALFHIPQVQVRDEGQYRCIIIYGDAWDYKYLTLKVKASYRKINTHILKVPETDEVELTCQATGYPLAEVSWPNVSVPANTSHSRTPEGLYQVTSVLRLKPPPGRNFSCVFWNTHVRELTLASIDLQSQMEPRTHPT

SEQ ID NO: 735 - protein, 201 aa, synthetic construct
  REGION 1..201: note = PD-L2 ECD v69
LFTVTVPKELYIIEQGSNVTLECSFDTGSHVNLGAITASLQKVENDASPHRERATLLEEQLPLGKASFHIPHVQVGDEGQYQCIIIYGDAWDYKYLTLKVKASYRKINTHILKVPETDEVELTCQATGYPLAEVSWPNVSVPANTSHSRTPEGLYQVTSVLRLKPPPGRNFSCVFWNTHVRELTLASIDLQSQMEPRTHPT

SEQ ID NO: 736 - protein, 201 aa, synthetic construct
  REGION 1..201: note = PD-L2 ECD v70
LFTVTVPKELYIVEQGSNVTLECNFDTGSHVNLGAITASLQKVVNDASPHRERATLLEEQLPLGKASFHIPQVQVRDEGQYRCIIIYGDAWDYKYLTLKVKASYRKINTHILKVPETDEVELTCQATGYPLAEVSWPNVSVPANTSHSRTPEGLYQVTSVLRLKPPPGRNFSCVFWNTHVRELTLASIDLQSQMEPRTHPT

SEQ ID NO: 737 - protein, 201 aa, synthetic construct
  REGION 1..201: note = PD-L2 ECD v71
LFTVTVPKELYIIEQGSDVTLECNFDTGSHVNLGAITASLQKVENDASPHRERATLLEEQLPLGKASFHIPHAQVGDEGQYQCIITYGDAWDYKYLTLKVKASYRKINTHILKVPETDEVELTCQATGYPLAEVSWPNVSVPANTSHSRTPEGLYQVTSVLRLKPPPGRNFSCVFWNTHVRELTLASIDLQSQMEPRTHPT

SEQ ID NO: 738 - protein, 201 aa, synthetic construct
  REGION 1..201: note = PD-L2 ECD v72
LFTVTVPKELYIVEQGSNVTLECNFDTGSHVNLGAIAASLQKVDNDTCPHRERATLLEEQLPLGKALFHIPQVQVRDEGQYRCIIIYGDAWDYKYLTLKVKASYRKINTHILKVPETDEVELTCQATGYPLAEVSWPNVSVPANTSHSRTPEGLYQVTSVLRLKPPPGRNFSCVFWNTHVRELTLASIDLQSQMEPRTHPT

SEQ ID NO: 739 - protein, 201 aa, synthetic construct
  REGION 1..201: note = PD-L2 ECD v73
LFTVTVPKELYIIEQGSNVTLECNFDTGSHVNHGAITASLQKVENDTSPHRERATLLEEQLPLGKALFHIPQVQVGDEGQYRCIIIYGDAWDYKYLTLKVKASYRKINTHILKVPETDEVELTCQATGYPLAEVSWPNVSVPANTSHSRTPEGLYQVTSVLRLKPPPGRNFSCVFWNTHVRELTLASIDLQSQMEPRTHPT

SEQ ID NO: 740 - protein, 201 aa, synthetic construct
  REGION 1..201: note = PD-L2 ECD v74
LFTVTVPKELYIVEQGSNVTLECNFDTGSHVNLGAITASLQKVENDASPHRERATLLEEQLPLGKASFHIPHVQVGDEGQYQCIITYGVAWDYKYLTLKVKASYRKINTHILKVPETDEVELTCQATGYPLAEVSWPNVSVPANTSHSRTPEGLYQVTSVLRLKPPPGRNFSCVFWNTHVRELTLASIDLQSQMEPRTHPT

SEQ ID NO: 741 - protein, 201 aa, synthetic construct
  REGION 1..201: note = PD-L2 ECD v75
LFTVTVPKELYIIEQGSNVTLECNFDTGSHVNLGAITAILQKVDNDTSPHRERATLLEEQLPLGKASFHIPHVQGGDEGQYRCIIIYGDAWDYKYLTLKVKASYRKINTHILKVPETDEVELTCQATGYPLAEVSWPNVSVPANTSHSRTPEGLYQVTSVLRLKPPPGRNFSCVFWNTHVRELTLASIDLQSQMEPRTHPT

SEQ ID NO: 742 - protein, 201 aa, synthetic construct
  REGION 1..201: note = PD-L2 ECD v76
LFTVTVPKELYIIEQGSNVTLECNFDTGSHVNLGAITASLQKVENDASPHRERATLLEEQLPLGKALFHIPQVQVGDEGQYRCIIIYGDAWDYKYLTLKVKASYRKINTHILKVPETDEVELTCQATGYPLAEVSWPNVSVPANTSHSRTPEGLYQVTSVLRLKPPPGRNFSCVFWNTHVRELTLASIDLQSQMEPRTHPT

SEQ ID NO: 743 - protein, 201 aa, synthetic construct
  REGION 1..201: note = PD-L2 ECD v77
LFTVTVPKELYIVEQGSNVTLECNFDTGSHVNLGAITASLQKVENDASPHRERATLLEEQLPLGKALFHIPHVQVGDEGQYRCIIIYGDAWDYKYLTLKVKASYRKINTHILKVPETDEVELTCQATGYPLAEVSWPNVSVPANTSHSRTPEGLYQVTSVLRLKPPPGRNFSCVFWNTHVRELTLASIDLQSQMEPRTHPT

SEQ ID NO: 744 - protein, 98 aa, synthetic construct
  REGION 1..98: note = PD-L2 IgV v1
FTVTVPKELYIIEQGSNVTLECNFDTGSHVNLGAITASLQKVENDTSPHRERATLLEEQLPLGKASFHIPQVQVRDEGQYQCIIIYGVAWDYKYLTLK

SEQ ID NO: 745 - protein, 98 aa, synthetic construct
  REGION 1..98: note = PD-L2 IgV v2
FTVTVPKELYIIEHGSNVTLECDFDTGSHVNLGAITASLQKVENDTSPHRERATLLEEQLPLGKASFHIPQVQVRDEGQYQCIIIYGVAWDYKYLTLK

SEQ ID NO: 746 - protein, 98 aa, synthetic construct
  REGION 1..98: note = PD-L2 IgV v3
FTVTVPKELYIIEHGSNVTLECNFDTGSHVNLGAITASLQKVDNDTSPHRERATLLEEQLPLGKASFHIPQVQVRDEGQYQCIIIYGVAWDYKYLTLK

SEQ ID NO: 747 - protein, 98 aa, synthetic construct
  REGION 1..98: note = PD-L2 IgV v4
FTVTVPKELYIIEHGSNVTLECNFDTGSHVNLGAITASLQKVENDTSPHRERATLLEEQLPLGKASFHIPQVQVRDEGQYQCIIIYGDAWDYKYLTLK

SEQ ID NO: 748 - protein, 98 aa, synthetic construct
  REGION 1..98: note = PD-L2 IgV v5
FTVTVPKELYIIEHGSNVTLECNFDTGSHVNLGAITASLQKVENDTSPHRERATLLEEQLPLGKASFHIPQVQVRDEGQYRCIIIYGDAWDYKYLTLK

SEQ ID NO: 749 - protein, 98 aa, synthetic construct
  REGION 1..98: note = PD-L2 IgV v6
FTVTVPKELYIIEHGSNVTLECNFDTGSHVNLGAITASLQKVENDTSPHRERATLLEGQLPLGKASFHIPQVQVRDEGQYRCIIIYGVAWDYKYLTLK

SEQ ID NO: 750 - protein, 98 aa, synthetic construct
  REGION 1..98: note = PD-L2 IgV v7
FTVTVPKELYIIEHGSNVTLECNFDTGSHVNLGAITAILQKVENDTSPHRERATLLEEQLPLGKASFHIPQVQVRDEGQYQCIIIYGDAWDYKYLTLK

SEQ ID NO: 751 - protein, 98 aa, synthetic construct
  REGION 1..98: note = PD-L2 IgV v8
FTVTVPKELYIIEHGSNVTLECNFDTGSHVNLGAITASLQKVENDTSPHRERATLLEEQLPLGKALFHIPQVQVRDEGQYQCIIIYGDAWDYKYLTLK

SEQ ID NO: 752 - protein, 98 aa, synthetic construct
  REGION 1..98: note = PD-L2 IgV v9
FTVTVPKELYIIEHGSNVTLECNFDTGSHVNLGAITASLQKVENDTSPHRERATLLEEQLPLGKALFHIPQVQVRDEGQYQCIFIYGVAWDYKYLTLK

SEQ ID NO: 753 - protein, 98 aa, synthetic construct
  REGION 1..98: note = PD-L2 IgV v10
FTVTVPKELYIIEHGSNVTLECNFDTGSHVNLGAITASLQKVENDTSPHRERATLLEEQLPLGKALFHIPQVQVRDEGQYQCIITYGVAWDYKYLTLK

SEQ ID NO: 754 - protein, 98 aa, synthetic construct
  REGION 1..98: note = PD-L2 IgV v11
FTVTVPKELYIIEQGSNVTLECNFDTGSHVNLGAITASLQKVENDTSPHRERATLLEEQLPLGRASFHIPQVQVRDEGQYQCIIIYGVAWDYKYLTLK

SEQ ID NO: 755 - protein, 98 aa, synthetic construct
  REGION 1..98: note = PD-L2 IgV v12
FTVTVPKELYIIEQGSNVTLECNFDTGSHVNLGAITASLQKVENDTSPHRERATLLEEQLPLGKASFHIPHVQVRDEGQYQCIIIYGDAWDYKYLTLK

SEQ ID NO: 756 - protein, 98 aa, synthetic construct
  REGION 1..98: note = PD-L2 IgV v13
FTVTVPKELYIIEQGSNVTLECNFDTGSHVNLGAITASLQKVENDTSPHRERATLLEEQLPLGKALFHIPQVQVGDEGQYQCIIIYGVAWDYKYLTLK

SEQ ID NO: 757 - protein, 98 aa, synthetic construct
  REGION 1..98: note = PD-L2 IgV v14
FTVTVPKELYIIEQGSNVTLECNFDTGSHVNLGAITASLQKVENDTSPHRERATLLEEQLPLGKASFHIPQVQVGDEGQYQCIFIYGVAWDYKYLTLK

SEQ ID NO: 758 - protein, 98 aa, synthetic construct
  REGION 1..98: note = PD-L2 IgV v15
FTVTVPKELYIIEQGSNVTLECNFDTGSHVNLGAITASLQKVENDASPHRERATLLEEQLPLGKASFHIPQVQVRDEGQYRCIIIYGVAWDYKYLTLK

SEQ ID NO: 759 - protein, 98 aa, synthetic construct
  REGION 1..98: note = PD-L2 IgV v16
FTVTVPKELYIIEQGSNVTLECNFDTGSHVNLGAITASLQKVENDTSPHRERATLLEEQLPLGKASFHIPQVQVRDEGQYRCIIIYGDAWDYKYLTLK

SEQ ID NO: 760 - protein, 98 aa, synthetic construct
  REGION 1..98: note = PD-L2 IgV v17
FTVTVPKELYIIEQGSNVTLESNFDTGSHVNLGAITASLQKVENDTSPHRERATLLEEQLPLGKASFHIPQVQVRDEGQYQCIITYGVAWDYKYLTLK

SEQ ID NO: 761 - protein, 98 aa, synthetic construct
  REGION 1..98: note = PD-L2 IgV v18
FTVTVPKELYIIEQGSNVTLECNFDTGSHVNLGAITAILQKVENDTSPHRERATLLEEQLPLGKASFHIPQVQVRDEGQYQCIITYGVAWDYKYLTLK

SEQ ID NO: 762 - protein, 98 aa, synthetic construct; identical to SEQ ID NO: 757
  REGION 1..98: note = PD-L2 IgV v19

SEQ ID NO: 763 - protein, 98 aa, synthetic construct
  REGION 1..98: note = PD-L2 IgV v20
FTVTVPKELYIIEHGSNVTLECNFDTGSHVNLGAITASLQKVDNDTSPHRERATLLEEQLPLGKASFHIPQVQVRDEGQYQCIIIYGDARDYKYLTLK

SEQ ID NO: 764 - protein, 98 aa, synthetic construct
  REGION 1..98: note = PD-L2 IgV v21
FTVTVPKELYIVEHGSNVTLECNFDTGSHVNLGAITASLQKVENDTSPHRERATLLEEQLPLGKALFHIPQVQVRDEGQYQCIIIYGDAWDYKYLTLK

SEQ ID NO: 765 - protein, 98 aa, synthetic construct
  REGION 1..98: note = PD-L2 IgV v22
FTVTVPKELYIIEQGSNVTLECNFDTGSHVNLGAITASLQKVENDTSPHRERATLLEEQLPLGKALFHIPQVQVRDEGQYQCIITYGVAWDYKYLTLK

SEQ ID NO: 766 - protein, 98 aa, synthetic construct
  REGION 1..98: note = PD-L2 IgV v23
FTVTVPKELYIVEQGSNVTLECNFDTGSHVNLGAITASLQKVENDTSPHRERATLLEEQLPLGKALFHIPQVQVRDEGQYQCIITYGVAWDYKYLTLK

SEQ ID NO: 767 - protein, 98 aa, synthetic construct
  REGION 1..98: note = PD-L2 IgV v24
FTVTVPKELYIVEQGSNVTLECNFDTGSHVNLGAITASLQKVDNDTSPHRERATLLEEQLPLGKASFHIPQVQVRDEGQYQCIIIYGDAWDYKYLTLK

SEQ ID NO: 768 - protein, 98 aa, synthetic construct
  REGION 1..98: note = PD-L2 IgV v25
FTVTVPKELYIVEHGSNVTLECNFDTGSHVNLGAITAILQKVDNDTSPHRERATLLEEQLPLGKASFHIPQVQVRDEGQYRCIIIYGDAWDYKYLTLK

SEQ ID NO: 769 - protein, 98 aa, synthetic construct
  REGION 1..98: note = PD-L2 IgV v26
FTVTVPKELYIVEHGSNVTLECNFDTGSHVNLGAITASLQKVDNDTSPHRERATLLEEQLPLGKASFHIPQVQVRDEGQYRCIIIYGDAWDYKYLTLK

SEQ ID NO: 770 - protein, 98 aa, synthetic construct
  REGION 1..98: note = PD-L2 IgV v27
FTVTVPKELYIVEHGSNVTLECNFDTGSHVNLGAITASLQKVENDTSPHRERATLLEEQLPLGKASFHIPHVQVGDEGQYQCIITYGVAWDYKYLTLK

SEQ ID NO: 771 - protein, 98 aa, synthetic construct
  REGION 1..98: note = PD-L2 IgV v28
FTVTVPKELYIVEQGSNVTLECNFDTGSHVNLGAITASLQKVENDTSPHRERATLLEEQLPLGKASFHIPQVQVGDEGQYQCIFIYGVAWDYKYLTLK

SEQ ID NO: 772 - protein, 98 aa, synthetic construct
  REGION 1..98: note = PD-L2 IgV v29
FTVTVPKELYIIEQGSNVTLECNFDTGSHVNLGAITAILQKVENDTSPHRERATLLEEQLPLGKASFHIPQVQVGDEGQYQCIIIYGDAWDYKYLTLK

SEQ ID NO: 773 - protein, 98 aa, synthetic construct
  REGION 1..98: note = PD-L2 IgV v30
FTVTVPKELYIIEQGSNVTLECNFDTGSHVNLGAITASLQKVENDTSPHRERATLLEEQLPLGKALFHIPQVQVGDEGQYQCIFIYGVAWDYKYLTLK

SEQ ID NO: 774 - protein, 98 aa, synthetic construct
  REGION 1..98: note = PD-L2 IgV v31
FTVTVPKELYIIEQGSNVTLECNFDTGSHVNLGAITASLQKVENDASPHRERATLLEEQLPLGKASFHIPHVQVGDEGQYQCIITYGVAWDYKYLTLK

SEQ ID NO: 775 - protein, 98 aa, synthetic construct
  REGION 1..98: note = PD-L2 IgV v32
FTVTVPKELYIIEQGSNVTLECNFDTGSHVNLGAITASLQKVENDASPHRERATLLEEQLPLGKASFHIPHVQVGDEGQYQCIIIYGVAWDYKYLTLK

SEQ ID NO: 776 - protein, 98 aa, synthetic construct
  REGION 1..98: note = PD-L2 IgV v33
FTVTVPKELYIVEQGSNVTLECNFDTGSHVNLGAITASLQKVENDASPHRERATLLEEQLPLGKASFHIPHVQVGDEGQYQCIIIYGVAWDYKYLTLK

SEQ ID NO: 777 - protein, 98 aa, synthetic construct
  REGION 1..98: note = PD-L2 IgV v34
FTVTVPKELYIIEQGSNVTLECNFDTGSHVNLGAITASLQKVDNDTSPHRERATLLEEQLPLGKASFHIPQVQVGDEGQYQCIFIYGVAWDYKYLTLK

SEQ ID NO: 778 - protein, 98 aa, synthetic construct
  REGION 1..98: note = PD-L2 IgV v35
FTVTVPKELYIIEQGSNVTLECNFDTGSHVNLGAITAILQKVENDTSPHRERATLLEEQLPLGKALFHIPQVQVRDEGQYQCIIIYGDAWDYKYLTLK

SEQ ID NO: 779 - protein, 98 aa, synthetic construct
  REGION 1..98: note = PD-L2 IgV v36
FTVTVPKELYIIEQGSNVTLECNFDTGSHVDLGAITASLQKVENDTSPHRERATLLEEQLPLGKALFHIPQVQVRDEGQYQCIIIYGDAWDYKYLTLK

SEQ ID NO: 780 - protein, 98 aa, synthetic construct
  REGION 1..98: note = PD-L2 IgV v37
FTVTVPKELYIIEHGSNVTLECNFDTGSHVDLGAITASLQKVENDTSPHRERATLLEEQLPLGKALFHIPQVQVRDEGQYQCIIIYGDAWDYKYLTLK

SEQ ID NO: 781 - protein, 98 aa, synthetic construct
  REGION 1..98: note = PD-L2 IgV v38
FTVTVPKELYIIEQGSNVTLECNFDTGSHVNLGAITASLQKVENDTSPHRERATLLEEQLPLGKALFHIPHVQVGDEGQYQCIIIYGDAWDYKYLTLK

SEQ ID NO: 782 - protein, 98 aa, synthetic construct
  REGION 1..98: note = PD-L2 IgV v39
FTVTVPKELYIIEQGSNVTLECNFDTGSHVNLGAITASLQKVENDTSPHRERATLLEEQLPLGKASFHIPHVRVGDEGQYQCIITYGVAWDYKYLTLK

SEQ ID NO: 783 - protein, 98 aa, synthetic construct
  REGION 1..98: note = PD-L2 IgV v40
FTVTVPKELYIIEHGSNVTLECNFDTVSHVNLGAITASLQKVENDTSPHRERATLLEEQLPLGKASFHIPHVQVGDEGQYQCIITYGVAWDYKYLTLK

SEQ ID NO: 784 - protein, 98 aa, synthetic construct
  REGION 1..98: note = PD-L2 IgV v41
FTVTVPKELYIVEQGSNVTLECNFDTGSHVNLGAITAILQKVDNDTSPHRERATLLEEQLPLGKALFHIPQVQVRDEGQYQCIIIYGVAWDYKYLTLK

SEQ ID NO: 785 - protein, 98 aa, synthetic construct
  REGION 1..98: note = PD-L2 IgV v42
FTVTVPKELYIIEHGSNVTLECNFDTGSHVNLGAITASLQKVDNDTSPHRERATLLEEQLPLGKALFHIPHVQVRDEGQYRCIIIYGDAWDYKYLTLK

SEQ ID NO: 786 - protein, 98 aa, synthetic construct
  REGION 1..98: note = PD-L2 IgV v43
FTVTVPKELYIIEQGSNVTLECNFDTGSHVNLGAITASLQKVENDTSPHRERATLLEEQLPLGKASFHIPQVQVRDEGQYQCIIIYGDAWDYKYLTLK

SEQ ID NO: 787 - protein, 98 aa, synthetic construct
  REGION 1..98: note = PD-L2 IgV v44
FTVTVPKELYIIEQGSNVTLECNFDTGSHVNLGAITASLQKVENDASPHRERATLLEEQLPLGKASFHIPQVQVRDEGQYQCIIIYGVAWDYKYLTLK

SEQ ID NO: 788 - protein, 98 aa, synthetic construct
  REGION 1..98: note = PD-L2 IgV v45
FTVTVPKELYIVEQGSNVTLECNFDTGSHVNLGAITASLQKVENDTSPHRERATLLEEQLPLGKASFHIPQVQVRDEGQYRCIIIYGVAWDYKYLTLK

SEQ ID NO: 789 - protein, 98 aa, synthetic construct
  REGION 1..98: note = PD-L2 IgV v46
FTVTVPKELYIVEQGSNVTLECNFDTGSHVNLGAITASLQKVENDTSPHRERATLLEEQLPLGKASFHIPQVQVRDEGQYQCIIIYGDAWDYKYLTLK

SEQ ID NO: 790 - protein, 98 aa, synthetic construct
  REGION 1..98: note = PD-L2 IgV v47
FTVTVPKELYIVEHGSNVTLECNFDTGSHVNLGAITASLQKVENDTSPHRERATLLEEQLPLGKALFHIPQVQVRDEGQYRCIIIYGDAWDYKYLTLK

SEQ ID NO: 791 - protein, 98 aa, synthetic construct
  REGION 1..98: note = PD-L2 IgV v48
FTVTVPKELYIVEQGSNVTLECNFDTGSHVNLGAITASLQKVENDTSPHRERATLLEEQLPLGKASFHIPQVQVRDEGQYRCIIIYGDAWDYKYLTLK

SEQ ID NO: 792 - protein, 98 aa, synthetic construct
  REGION 1..98: note = PD-L2 IgV v49
FTVTVPKELYIIEQGSNVTLECNFDTGSHMNLGAITASLQKVENDTSPHRERATLLEEQLPLGKALFHIPQVQVRDEGQYRCIIIYGDAWDYKYLTLK

SEQ ID NO: 793 - protein, 98 aa, synthetic construct
  REGION 1..98: note = PD-L2 IgV v50
FTVTVPKELYIVEQGSNVTLECNFDTGSHVNLGAITASLQKVENDASPHRERATLLEEQLPLGKASFHIPQVQVRDEGQYRCIIIYGVAWDYKYLTLK

SEQ ID NO: 794 - protein, 98 aa, synthetic construct
  REGION 1..98: note = PD-L2 IgV v51
FTVTVPKELYIVEQGSNVTLECNFDTGSHANLGAITASLQKVESDTSPHRERATLLEEQLPLGKASFHIPQVQVRDEGQYRCIIIYGDAWDYKYLTLK

SEQ ID NO: 795 - protein, 98 aa, synthetic construct
  REGION 1..98: note = PD-L2 IgV v52
  VARIANT 64: note = Xaa = unknown
FTVTVPKELYIVEHGSNVALECNFDTGSHVNLGAITASLQKVENDASPHRERATLLEEQLPLGXASFHIPQVQVRDEGQYRCIIIYGDAWDYKYLTLK

SEQ ID NO: 796 - protein, 98 aa, synthetic construct
  REGION 1..98: note = PD-L2 IgV v53
FTVTVPKELYIIEQGSNVTLECNFDTGSHVNLGAITASLQKVENDASPHRERATLLEEQLPLGKASFLIPQVQVRDEGQYRCIIIYGDAWDYKYLTLK

SEQ ID NO: 797 - protein, 98 aa, synthetic construct
  REGION 1..98: note = PD-L2 IgV v54
FTVTVPKELYIVEQGSNVTLECNFDTGSHVNLGAITASLQKVENDASPHRERATLLEEQLPLGKASFLIPQVQVGDEGQYQCIIIYGDAWDYKYLTLK

SEQ ID NO: 798 - protein, 98 aa, synthetic construct
  REGION 1..98: note = PD-L2 IgV v55
FTVTVPKELYVVEQGSNVTLECNFDTGSHVNLGAITASLQKVENDASPHRERATLLEEQLPLGKASFHIPQVQVRDEGQYRCIIIYGDAWDYKYLTLK

SEQ ID NO: 799 - protein, 98 aa, synthetic construct
  REGION 1..98: note = PD-L2 IgV v56
FTVTVPKELYIVEQGSNVTLECNFDTGSHVNLGAITASLQKVENDTSPHRERATLLEEQLPLGKASFHIPQVQVGNEGQYRCIIIYGDAWDYKYLTLK

SEQ ID NO: 800 - protein, 98 aa, synthetic construct
  REGION 1..98: note = PD-L2 IgV v57
FTVTVPKELYIVEQGSNVTLECNFDTGSHVNLGAITASLQKVENDASPHRERATLLEEQLPLGKASFHIPQVQVGDEGQYQCIIIYGDAWDYKYLTLK

SEQ ID NO: 801 - protein, 98 aa, synthetic construct
  REGION 1..98: note = PD-L2 IgV v58
FTVTVPKELYIVEQGSNVTLECNFDTGSHVNLGAITASLQKVENDASPHRERATLLEEQLPLGKASFHIPQVQVRDEGQYRCIIIYGDAWDYKYLTLK

SEQ ID NO: 802 - protein, 98 aa, synthetic construct
  REGION 1..98: note = PD-L2 IgV v60
FTVTVPKELYIVEQGSNVTLECDFDTGSHVNLGAITASLQKVENDTSPHRERATLLEEQLPLGKASFHIPQVQVRDEGQYRCIIIYGDAWDYKYLTLK

SEQ ID NO: 803 - protein, 98 aa, synthetic construct
  REGION 1..98: note = PD-L2 IgV v61
FTVTVPKELYIVEQGSNVTLECNFDTGSHVNLGAVTASLQKVENDASPHRERATLLEEQLPLGKALFHIPQVQVRDEGQYQCIIIYGDAWDYKYLTLK

SEQ ID NO: 804 - protein, 98 aa, synthetic construct
  REGION 1..98: note = PD-L2 IgV v62
FTVTVPKELYIIEQGSNVTLECNFDTGSHVNLGAITASLQKVENDASPHRERATLLEEQLPLGRALFHIPQVQVRDEGQYRCIIIYGDAWDYKYLTLK

SEQ ID NO: 805 - protein, 98 aa, synthetic construct
  REGION 1..98: note = PD-L2 IgV v63
FTVTVPKELYIIEQGSNVTLECNFDTGSHVNPGAITASLQKVENDASPHRERATLLEEQLPLGKALFHISQVQVRDEGQYQCIIIYGDAWDYKYLTLK

SEQ ID NO: 806 - protein, 98 aa, synthetic construct
  REGION 1..98: note = PD-L2 IgV v64
FTVTVPKELYIVEQGSNVTLECNFDTGSHVNLGAITASLQKVENDTSPHRERATLLEEQLPLGKASFHIPHVQVGDEGQYQCIITYGVAWDYKYLTLK

SEQ ID NO: 807 - protein, 98 aa, synthetic construct
  REGION 1..98: note = PD-L2 IgV v65
FTVTVPKELYIIEQGSNVTLECNFDTGSHVNLGAITASLQKVENDASPHRERATLLEEQLPLGKALFHIPQVQVRDEGQYRCIIIYGDAWDYKYLTLK

SEQ ID NO: 808 - protein, 98 aa, synthetic construct
  REGION 1..98: note = PD-L2 IgV v66
LTVTVPKELYIIEQGSNVTLECNFDTGSHVNLGAITASLQKVENEASPHRERATLLEEQLPLGKASFHIPHVQVGDEGQYRCIIIYGDAWDYKYLTLK

SEQ ID NO: 809 - protein, 98 aa, synthetic construct
  REGION 1..98: note = PD-L2 IgV v67
FTVTVPKELYIVEQGSNVTLECNFDTGSHVNFGAITASLQKVENDASPHRERATLLEEQLPLGKASFHIPQVQVRDEGQYRCIIIYGDAWDYKYLTLK

SEQ ID NO: 810 - protein, 98 aa, synthetic construct
  REGION 1..98: note = PD-L2 IgV v68
FTVTVPKELYIVEQGSNVTLECNFDTGSHVNLGAITASLQKVENDASPHRERATLLGEQLPLGKALFHIPQVQVRDEGQYRCIIIYGDAWDYKYLTLK

SEQ ID NO: 811 - protein, 98 aa, synthetic construct
  REGION 1..98: note = PD-L2 IgV v69
FTVTVPKELYIIEQGSNVTLECSFDTGSHVNLGAITASLQKVENDASPHRERATLLEEQLPLGKASFHIPHVQVGDEGQYQCIIIYGDAWDYKYLTLK

SEQ ID NO: 812 - protein, 98 aa, synthetic construct
  REGION 1..98: note = PD-L2 IgV v70
FTVTVPKELYIVEQGSNVTLECNFDTGSHVNLGAITASLQKVVNDASPHRERATLLEEQLPLGKASFHIPQVQVRDEGQYRCIIIYGDAWDYKYLTLK

SEQ ID NO: 813 - protein, 98 aa, synthetic construct
  REGION 1..98: note = PD-L2 IgV v71
FTVTVPKELYIIEQGSDVTLECNFDTGSHVNLGAITASLQKVENDASPHRERATLLEEQLPLGKASFHIPHAQVGDEGQYQCIITYGDAWDYKYLTLK

SEQ ID NO: 814 - protein, 98 aa, synthetic construct
  REGION 1..98: note = PD-L2 IgV v72
FTVTVPKELYIVEQGSNVTLECNFDTGSHVNLGAIAASLQKVDNDTCPHRERATLLEEQLPLGKALFHIPQVQVRDEGQYRCIIIYGDAWDYKYLTLK

SEQ ID NO: 815 - protein, 98 aa, synthetic construct
  REGION 1..98: note = PD-L2 IgV v73
FTVTVPKELYIIEQGSNVTLECNFDTGSHVNHGAITASLQKVENDTSPHRERATLLEEQLPLGKALFHIPQVQVGDEGQYRCIIIYGDAWDYKYLTLK

SEQ ID NO: 816 - protein, 98 aa, synthetic construct
  REGION 1..98: note = PD-L2 IgV v74
FTVTVPKELYIVEQGSNVTLECNFDTGSHVNLGAITASLQKVENDASPHRERATLLEEQLPLGKASFHIPHVQVGDEGQYQCIITYGVAWDYKYLTLK

SEQ ID NO: 817 - protein, 98 aa, synthetic construct
  REGION 1..98: note = PD-L2 IgV v75
FTVTVPKELYIIEQGSNVTLECNFDTGSHVNLGAITAILQKVDNDTSPHRERATLLEEQLPLGKASFHIPHVQGGDEGQYRCIIIYGDAWDYKYLTLK

SEQ ID NO: 818 - protein, 98 aa, synthetic construct
  REGION 1..98: note = PD-L2 IgV v76
FTVTVPKELYIIEQGSNVTLECNFDTGSHVNLGAITASLQKVENDASPHRERATLLEEQLPLGKALFHIPQVQVGDEGQYRCIIIYGDAWDYKYLTLK

SEQ ID NO: 819 - protein, 98 aa, synthetic construct
  REGION 1..98: note = PD-L2 IgV v77
FTVTVPKELYIVEQGSNVTLECNFDTGSHVNLGAITASLQKVENDASPHRERATLLEEQLPLGKALFHIPHVQVGDEGQYRCIIIYGDAWDYKYLTLK

SEQ ID NO: 820 - protein, 102 aa, synthetic construct
  REGION 1..102: note = PD-L2 IgV v1
LFTVTVPKELYIIEQGSNVTLECNFDTGSHVNLGAITASLQKVENDTSPHRERATLLEEQLPLGKASFHIPQVQVRDEGQYQCIIIYGVAWDYKYLTLKVKA

SEQ ID NO: 821 - protein, 102 aa, synthetic construct
  REGION 1..102: note = PD-L2 IgV v2
LFTVTVPKELYIIEHGSNVTLECDFDTGSHVNLGAITASLQKVENDTSPHRERATLLEEQLPLGKASFHIPQVQVRDEGQYQCIIIYGVAWDYKYLTLKVKA

SEQ ID NO: 822 - protein, 102 aa, synthetic construct
  REGION 1..102: note = PD-L2 IgV v3
LFTVTVPKELYIIEHGSNVTLECNFDTGSHVNLGAITASLQKVDNDTSPHRERATLLEEQLPLGKASFHIPQVQVRDEGQYQCIIIYGVAWDYKYLTLKVKA

SEQ ID NO: 823 - protein, 102 aa, synthetic construct
  REGION 1..102: note = PD-L2 IgV v4
LFTVTVPKELYIIEHGSNVTLECNFDTGSHVNLGAITASLQKVENDTSPHRERATLLEEQLPLGKASFHIPQVQVRDEGQYQCIIIYGDAWDYKYLTLKVKA

SEQ ID NO: 824 - protein, 102 aa, synthetic construct
  REGION 1..102: note = PD-L2 IgV v5
LFTVTVPKELYIIEHGSNVTLECNFDTGSHVNLGAITASLQKVENDTSPHRERATLLEEQLPLGKASFHIPQVQVRDEGQYRCIIIYGDAWDYKYLTLKVKA

SEQ ID NO: 825 - protein, 102 aa, synthetic construct
  REGION 1..102: note = PD-L2 IgV v6
LFTVTVPKELYIIEHGSNVTLECNFDTGSHVNLGAITASLQKVENDTSPHRERATLLEGQLPLGKASFHIPQVQVRDEGQYRCIIIYGVAWDYKYLTLKVKA

SEQ ID NO: 826 - protein, 102 aa, synthetic construct
  REGION 1..102: note = PD-L2 IgV v7
LFTVTVPKELYIIEHGSNVTLECNFDTGSHVNLGAITAILQKVENDTSPHRERATLLEEQLPLGKASFHIPQVQVRDEGQYQCIIIYGDAWDYKYLTLKVKA

SEQ ID NO: 827 - protein, 102 aa, synthetic construct
  REGION 1..102: note = PD-L2 IgV v8
LFTVTVPKELYIIEHGSNVTLECNFDTGSHVNLGAITASLQKVENDTSPHRERATLLEEQLPLGKALFHIPQVQVRDEGQYQCIIIYGDAWDYKYLTLKVKA

SEQ ID NO: 828 - protein, 102 aa, synthetic construct
  REGION 1..102: note = PD-L2 IgV v9
LFTVTVPKELYIIEHGSNVTLECNFDTGSHVNLGAITASLQKVENDTSPHRERATLLEEQLPLGKALFHIPQVQVRDEGQYQCIFIYGVAWDYKYLTLKVKA

SEQ ID NO: 829 - protein, 102 aa, synthetic construct
  REGION 1..102: note = PD-L2 IgV v10
LFTVTVPKELYIIEHGSNVTLECNFDTGSHVNLGAITASLQKVENDTSPHRERATLLEEQLPLGKALFHIPQVQVRDEGQYQCIITYGVAWDYKYLTLKVKA

SEQ ID NO: 830 - protein, 102 aa, synthetic construct
  REGION 1..102: note = PD-L2 IgV v11
LFTVTVPKELYIIEQGSNVTLECNFDTGSHVNLGAITASLQKVENDTSPHRERATLLEEQLPLGRASFHIPQVQVRDEGQYQCIIIYGVAWDYKYLTLKVKA

SEQ ID NO: 831 - protein, 102 aa, synthetic construct
  REGION 1..102: note = PD-L2 IgV v12
LFTVTVPKELYIIEQGSNVTLECNFDTGSHVNLGAITASLQKVENDTSPHRERATLLEEQLPLGKASFHIPHVQVRDEGQYQCIIIYGDAWDYKYLTLKVKA

SEQ ID NO: 832 - protein, 102 aa, synthetic construct
  REGION 1..102: note = PD-L2 IgV v13
LFTVTVPKELYIIEQGSNVTLECNFDTGSHVNLGAITASLQKVENDTSPHRERATLLEEQLPLGKALFHIPQVQVGDEGQYQCIIIYGVAWDYKYLTLKVKA

SEQ ID NO: 833 - protein, 102 aa, synthetic construct
  REGION 1..102: note = PD-L2 IgV v14
LFTVTVPKELYIIEQGSNVTLECNFDTGSHVNLGAITASLQKVENDTSPHRERATLLEEQLPLGKASFHIPQVQVGDEGQYQCIFIYGVAWDYKYLTLKVKA

SEQ ID NO: 834 - protein, 102 aa, synthetic construct
  REGION 1..102: note = PD-L2 IgV v15
LFTVTVPKELYIIEQGSNVTLECNFDTGSHVNLGAITASLQKVENDASPHRERATLLEEQLPLGKASFHIPQVQVRDEGQYRCIIIYGVAWDYKYLTLKVKA

SEQ ID NO: 835 - protein, 102 aa, synthetic construct
  REGION 1..102: note = PD-L2 IgV v16
LFTVTVPKELYIIEQGSNVTLECNFDTGSHVNLGAITASLQKVENDTSPHRERATLLEEQLPLGKASFHIPQVQVRDEGQYRCIIIYGDAWDYKYLTLKVKA

SEQ ID NO: 836 - protein, 102 aa, synthetic construct
  REGION 1..102: note = PD-L2 IgV v17
LFTVTVPKELYIIEQGSNVTLESNFDTGSHVNLGAITASLQKVENDTSPHRERATLLEEQLPLGKASFHIPQVQVRDEGQYQCIITYGVAWDYKYLTLKVKA

SEQ ID NO: 837 - protein, 102 aa, synthetic construct
  REGION 1..102: note = PD-L2 IgV v18
LFTVTVPKELYIIEQGSNVTLECNFDTGSHVNLGAITAILQKVENDTSPHRERATLLEEQLPLGKASFHIPQVQVRDEGQYQCIITYGVAWDYKYLTLKVKA

SEQ ID NO: 838 - protein, 102 aa, synthetic construct; identical to SEQ ID NO: 833
  REGION 1..102: note = PD-L2 IgV v19

SEQ ID NO: 839 - protein, 102 aa, synthetic construct
  REGION 1..102: note = PD-L2 IgV v20
LFTVTVPKELYIIEHGSNVTLECNFDTGSHVNLGAITASLQKVDNDTSPHRERATLLEEQLPLGKASFHIPQVQVRDEGQYQCIIIYGDARDYKYLTLKVKA

SEQ ID NO: 840 - protein, 102 aa, synthetic construct
  REGION 1..102: note = PD-L2 IgV v21
LFTVTVPKELYIVEHGSNVTLECNFDTGSHVNLGAITASLQKVENDTSPHRERATLLEEQLPLGKALFHIPQVQVRDEGQYQCIIIYGDAWDYKYLTLKVKA

SEQ ID NO: 841 - protein, 102 aa, synthetic construct
  REGION 1..102: note = PD-L2 IgV v22
LFTVTVPKELYIIEQGSNVTLECNFDTGSHVNLGAITASLQKVENDTSPHRERATLLEEQLPLGKALFHIPQVQVRDEGQYQCIITYGVAWDYKYLTLKVKA

SEQ ID NO: 842 - protein, 102 aa, synthetic construct
  REGION 1..102: note = PD-L2 IgV v23
LFTVTVPKELYIVEQGSNVTLECNFDTGSHVNLGAITASLQKVENDTSPHRERATLLEEQLPLGKALFHIPQVQVRDEGQYQCIITYGVAWDYKYLTLKVKA

SEQ ID NO: 843 - protein, 102 aa, synthetic construct
  REGION 1..102: note = PD-L2 IgV v24
LFTVTVPKELYIVEQGSNVTLECNFDTGSHVNLGAITASLQKVDNDTSPHRERATLLEEQLPLGKASFHIPQVQVRDEGQYQCIIIYGDAWDYKYLTLKVKA

SEQ ID NO: 844 - protein, 102 aa, synthetic construct
  REGION 1..102: note = PD-L2 IgV v25
LFTVTVPKELYIVEHGSNVTLECNFDTGSHVNLGAITAILQKVDNDTSPHRERATLLEEQLPLGKASFHIPQVQVRDEGQYRCIIIYGDAWDYKYLTLKVKA

SEQ ID NO: 845 - protein, 102 aa, synthetic construct
  REGION 1..102: note = PD-L2 IgV v26
LFTVTVPKELYIVEHGSNVTLECNFDTGSHVNLGAITASLQKVDNDTSPHRERATLLEEQLPLGKASFHIPQVQVRDEGQYRCIIIYGDAWDYKYLTLKVKA

SEQ ID NO: 846 - protein, 102 aa, synthetic construct
  REGION 1..102: note = PD-L2 IgV v27
LFTVTVPKELYIVEHGSNVTLECNFDTGSHVNLGAITASLQKVENDTSPHRERATLLEEQLPLGKASFHIPHVQVGDEGQYQCIITYGVAWDYKYLTLKVKA

SEQ ID NO: 847 - protein, 102 aa, synthetic construct
  REGION 1..102: note = PD-L2 IgV v28
LFTVTVPKELYIVEQGSNVTLECNFDTGSHVNLGAITASLQKVENDTSPHRERATLLEEQLPLGKASFHIPQVQVGDEGQYQCIFIYGVAWDYKYLTLKVKA

SEQ ID NO: 848 - protein, 102 aa, synthetic construct
  REGION 1..102: note = PD-L2 IgV v29
LFTVTVPKELYIIEQGSNVTLECNFDTGSHVNLGAITAILQKVENDTSPHRERATLLEEQLPLGKASFHIPQVQVGDEGQYQCIIIYGDAWDYKYLTLKVKA

SEQ ID NO: 849 - protein, 102 aa, synthetic construct
  REGION 1..102: note = PD-L2 IgV v30
LFTVTVPKELYIIEQGSNVTLECNFDTGSHVNLGAITASLQKVENDTSPHRERATLLEEQLPLGKALFHIPQVQVGDEGQYQCIFIYGVAWDYKYLTLKVKA

SEQ ID NO: 850 - protein, 102 aa, synthetic construct
  REGION 1..102: note = PD-L2 IgV v31
LFTVTVPKELYIIEQGSNVTLECNFDTGSHVNLGAITASLQKVENDASPHRERATLLEEQLPLGKASFHIPHVQVGDEGQYQCIITYGVAWDYKYLTLKVKA

SEQ ID NO: 851 - protein, 102 aa, synthetic construct
  REGION 1..102: note = PD-L2 IgV v32
LFTVTVPKELYIIEQGSNVTLECNFDTGSHVNLGAITASLQKVENDASPHRERATLLEEQLPLGKASFHIPHVQVGDEGQYQCIIIYGVAWDYKYLTLKVKA

SEQ ID NO: 852 - protein, 102 aa, synthetic construct
  REGION 1..102: note = PD-L2 IgV v33
LFTVTVPKELYIVEQGSNVTLECNFDTGSHVNLGAITASLQKVENDASPHRERATLLEEQLPLGKASFHIPHVQVGDEGQYQCIIIYGVAWDYKYLTLKVKA

SEQ ID NO: 853 - protein, 102 aa, synthetic construct
  REGION 1..102: note = PD-L2 IgV v34
LFTVTVPKELYIIEQGSNVTLECNFDTGSHVNLGAITASLQKVDNDTSPHRERATLLEEQLPLGKASFHIPQVQVGDEGQYQCIFIYGVAWDYKYLTLKVKA

SEQ ID NO: 854 - protein, 102 aa, synthetic construct
  REGION 1..102: note = PD-L2 IgV v35
LFTVTVPKELYIIEQGSNVTLECNFDTGSHVNLGAITAILQKVENDTSPHRERATLLEEQLPLGKALFHIPQVQVRDEGQYQCIIIYGDAWDYKYLTLKVKA

SEQ ID NO: 855 - protein, 102 aa, synthetic construct
  REGION 1..102: note = PD-L2 IgV v36
LFTVTVPKELYIIEQGSNVTLECNFDTGSHVDLGAITASLQKVENDTSPHRERATLLEEQLPLGKALFHIPQVQVRDEGQYQCIIIYGDAWDYKYLTLKVKA

SEQ ID NO: 856 - protein, 102 aa, synthetic construct
  REGION 1..102: note = PD-L2 IgV v37
LFTVTVPKELYIIEHGSNVTLECNFDTGSHVDLGAITASLQKVENDTSPHRERATLLEEQLPLGKALFHIPQVQVRDEGQYQCIIIYGDAWDYKYLTLKVKA

SEQ ID NO: 857 - protein, 102 aa, synthetic construct
  REGION 1..102: note = PD-L2 IgV v38
LFTVTVPKELYIIEQGSNVTLECNFDTGSHVNLGAITASLQKVENDTSPHRERATLLEEQLPLGKALFHIPHVQVGDEGQYQCIIIYGDAWDYKYLTLKVKA

SEQ ID NO: 858 - protein, 102 aa, synthetic construct
  REGION 1..102: note = PD-L2 IgV v39
LFTVTVPKELYIIEQGSNVTLECNFDTGSHVNLGAITASLQKVENDTSPHRERATLLEEQLPLGKASFHIPHVRVGDEGQYQCIITYGVAWDYKYLTLKVKA

SEQ ID NO: 859 - protein, 102 aa, synthetic construct
  REGION 1..102: note = PD-L2 IgV v40
LFTVTVPKELYIIEHGSNVTLECNFDTVSHVNLGAITASLQKVENDTSPHRERATLLEEQLPLGKASFHIPHVQVGDEGQYQCIITYGVAWDYKYLTLKVKA

SEQ ID NO: 860 - protein, 102 aa, synthetic construct
  REGION 1..102: note = PD-L2 IgV v41
LFTVTVPKELYIVEQGSNVTLECNFDTGSHVNLGAITAILQKVDNDTSPHRERATLLEEQLPLGKALFHIPQVQVRDEGQYQCIIIYGVAWDYKYLTLKVKA

SEQ ID NO: 861 - protein, 102 aa, synthetic construct
  REGION 1..102: note = PD-L2 IgV v42
LFTVTVPKELYIIEHGSNVTLECNFDTGSHVNLGAITASLQKVDNDTSPHRERATLLEEQLPLGKALFHIPHVQVRDEGQYRCIIIYGDAWDYKYLTLKVKA

SEQ ID NO: 862 - protein, 102 aa, synthetic construct
  REGION 1..102: note = PD-L2 IgV v43
LFTVTVPKELYIIEQGSNVTLECNFDTGSHVNLGAITASLQKVENDTSPHRERATLLEEQLPLGKASFHIPQVQVRDEGQYQCIIIYGDAWDYKYLTLKVKA

SEQ ID NO: 863 - protein, 102 aa, synthetic construct
  REGION 1..102: note = PD-L2 IgV v44
LFTVTVPKELYIIEQGSNVTLECNFDTGSHVNLGAITASLQKVENDASPHRERATLLEEQLPLGKASFHIPQVQVRDEGQYQCIIIYGVAWDYKYLTLKVKA

SEQ ID NO: 864 - protein, 102 aa, synthetic construct
  REGION 1..102: note = PD-L2 IgV v45
LFTVTVPKELYIVEQGSNVTLECNFDTGSHVNLGAITASLQKVENDTSPHRERATLLEEQLPLGKASFHIPQVQVRDEGQYRCIIIYGVAWDYKYLTLKVKA

SEQ ID NO: 865 - protein, 102 aa, synthetic construct
  REGION 1..102: note = PD-L2 IgV v46
LFTVTVPKELYIVEQGSNVTLECNFDTGSHVNLGAITASLQKVENDTSPHRERATLLEEQLPLGKASFHIPQVQVRDEGQYQCIIIYGDAWDYKYLTLKVKA

SEQ ID NO: 866 - protein, 102 aa, synthetic construct
  REGION 1..102: note = PD-L2 IgV v47
LFTVTVPKELYIVEHGSNVTLECNFDTGSHVNLGAITASLQKVENDTSPHRERATLLEEQLPLGKALFHIPQVQVRDEGQYRCIIIYGDAWDYKYLTLKVKA

SEQ ID NO: 867 - protein, 102 aa, synthetic construct
  REGION 1..102: note = PD-L2 IgV v48
LFTVTVPKELYIVEQGSNVTLECNFDTGSHVNLGAITASLQKVENDTSPHRERATLLEEQLPLGKASFHIPQVQVRDEGQYRCIIIYGDAWDYKYLTLKVKA

SEQ ID NO: 868 - protein, 102 aa, synthetic construct
  REGION 1..102: note = PD-L2 IgV v49
LFTVTVPKELYIIEQGSNVTLECNFDTGSHMNLGAITASLQKVENDTSPHRERATLLEEQLPLGKALFHIPQVQVRDEGQYRCIIIYGDAWDYKYLTLKVKA

SEQ ID NO: 869 - protein, 102 aa, synthetic construct
  REGION 1..102: note = PD-L2 IgV v50
LFTVTVPKELYIVEQGSNVTLECNFDTGSHVNLGAITASLQKVENDASPHRERATLLEEQLPLGKASFHIPQVQVRDEGQYRCIIIYGVAWDYKYLTLKVKA

SEQ ID NO: 870 - protein, 102 aa, synthetic construct
  REGION 1..102: note = PD-L2 IgV v51
LFTVTVPKELYIVEQGSNVTLECNFDTGSHANLGAITASLQKVESDTSPHRERATLLEEQLPLGKASFHIPQVQVRDEGQYRCIIIYGDAWDYKYLTLKVKA

SEQ ID NO: 871 - protein, 102 aa, synthetic construct
  REGION 1..102: note = PD-L2 IgV v52
  VARIANT 65: note = Xaa = unknown
LFTVTVPKELYIVEHGSNVALECNFDTGSHVNLGAITASLQKVENDASPHRERATLLEEQLPLGXASFHIPQVQVRDEGQYRCIIIYGDAWDYKYLTLKVKA

SEQ ID NO: 872 - protein, 102 aa, synthetic construct
  REGION 1..102: note = PD-L2 IgV v53
LFTVTVPKELYIIEQGSNVTLECNFDTGSHVNLGAITASLQKVENDASPHRERATLLEEQLPLGKASFLIPQVQVRDEGQYRCIIIYGDAWDYKYLTLKVKA

SEQ ID NO: 873 - protein, 102 aa, synthetic construct
  REGION 1..102: note = PD-L2 IgV v54
LFTVTVPKELYIVEQGSNVTLECNFDTGSHVNLGAITASLQKVENDASPHRERATLLEEQLPLGKASFLIPQVQVGDEGQYQCIIIYGDAWDYKYLTLKVKA

SEQ ID NO: 874 - protein, 102 aa, synthetic construct
  REGION 1..102: note = PD-L2 IgV v55
LFTVTVPKELYVVEQGSNVTLECNFDTGSHVNLGAITASLQKVENDASPHRERATLLEEQLPLGKASFHIPQVQVRDEGQYRCIIIYGDAWDYKYLTLKVKA

SEQ ID NO: 875 - protein, 102 aa, synthetic construct
  REGION 1..102: note = PD-L2 IgV v56
LFTVTVPKELYIVEQGSNVTLECNFDTGSHVNLGAITASLQKVENDTSPHRERATLLEEQLPLGKASFHIPQVQVGNEGQYRCIIIYGDAWDYKYLTLKVKA

SEQ ID NO: 876 - protein, 102 aa, synthetic construct
  REGION 1..102: note = PD-L2 IgV v57
LFTVTVPKELYIVEQGSNVTLECNFDTGSHVNLGAITASLQKVENDASPHRERATLLEEQLPLGKASFHIPQVQVGDEGQYQCIIIYGDAWDYKYLTLKVKA

SEQ ID NO: 877 - protein, 102 aa, synthetic construct
  REGION 1..102: note = PD-L2 IgV v58
LFTVTVPKELYIVEQGSNVTLECNFDTGSHVNLGAITASLQKVENDASPHRERATLLEEQLPLGKASFHIPQVQVRDEGQYRCIIIYGDAWDYKYLTLKVKA

SEQ ID NO: 878 - protein, 102 aa, synthetic construct
  REGION 1..102: note = PD-L2 IgV v60
LFTVTVPKELYIVEQGSNVTLECDFDTGSHVNLGAITASLQKVENDTSPHRERATLLEEQLPLGKASFHIPQVQVRDEGQYRCIIIYGDAWDYKYLTLKVKA

SEQ ID NO: 879 - protein, 102 aa, synthetic construct
  REGION 1..102: note = PD-L2 IgV v61
LFTVTVPKELYIVEQGSNVTLECNFDTGSHVNLGAVTASLQKVENDASPHRERATLLEEQLPLGKALFHIPQVQVRDEGQYQCIIIYGDAWDYKYLTLKVKA

SEQ ID NO: 880 - protein, 102 aa, synthetic construct
  REGION 1..102: note = PD-L2 IgV v62
LFTVTVPKELYIIEQGSNVTLECNFDTGSHVNLGAITASLQKVENDASPHRERATLLEEQLPLGRALFHIPQVQVRDEGQYRCIIIYGDAWDYKYLTLKVKA

SEQ ID NO: 881 - protein, 102 aa, synthetic construct
  REGION 1..102: note = PD-L2 IgV v63
LFTVTVPKELYIIEQGSNVTLECNFDTGSHVNPGAITASLQKVENDASPHRERATLLEEQLPLGKALFHISQVQVRDEGQYQCIIIYGDAWDYKYLTLKVKA

SEQ ID NO: 882 - protein, 102 aa, synthetic construct
  REGION 1..102: note = PD-L2 IgV v64
LFTVTVPKELYIVEQGSNVTLECNFDTGSHVNLGAITASLQKVENDTSPHRERATLLEEQLPLGKASFHIPHVQVGDEGQYQCIITYGVAWDYKYLTLKVKA

SEQ ID NO: 883 - protein, 102 aa, synthetic construct
  REGION 1..102: note = PD-L2 IgV v65
LFTVTVPKELYIIEQGSNVTLECNFDTGSHVNLGAITASLQKVENDASPHRERATLLEEQLPLGKALFHIPQVQVRDEGQYRCIIIYGDAWDYKYLTLKVKA

SEQ ID NO: 884 - protein, 102 aa, synthetic construct
  REGION 1..102: note = PD-L2 IgV v66
LLTVTVPKELYIIEQGSNVTLECNFDTGSHVNLGAITASLQKVENEASPHRERATLLEEQLPLGKASFHIPHVQVGDEGQYRCIIIYGDAWDYKYLTLKVKA

SEQ ID NO: 885 - protein, 102 aa, synthetic construct
  REGION 1..102: note = PD-L2 IgV v67
LFTVTVPKELYIVEQGSNVTLECNFDTGSHVNFGAITASLQKVENDASPHRERATLLEEQLPLGKASFHIPQVQVRDEGQYRCIIIYGDAWDYKYLTLKVKA

SEQ ID NO: 886 - protein, 102 aa, synthetic construct
  REGION 1..102: note = PD-L2 IgV v68
LFTVTVPKELYIVEQGSNVTLECNFDTGSHVNLGAITASLQKVENDASPHRERATLLGEQLPLGKALFHIPQVQVRDEGQYRCIIIYGDAWDYKYLTLKVKA

SEQ ID NO: 887 - protein, 102 aa, synthetic construct
  REGION 1..102: note = PD-L2 IgV v69
LFTVTVPKELYIIEQGSNVTLECSFDTGSHVNLGAITASLQKVENDASPHRERATLLEEQLPLGKASFHIPHVQVGDEGQYQCIIIYGDAWDYKYLTLKVKA

SEQ ID NO: 888 - protein, 102 aa, synthetic construct
  REGION 1..102: note = PD-L2 IgV v70
LFTVTVPKELYIVEQGSNVTLECNFDTGSHVNLGAITASLQKVVNDASPHRERATLLEEQLPLGKASFHIPQVQVRDEGQYRCIIIYGDAWDYKYLTLKVKA

SEQ ID NO: 889 - protein, 102 aa, synthetic construct
  REGION 1..102: note = PD-L2 IgV v71
LFTVTVPKELYIIEQGSDVTLECNFDTGSHVNLGAITASLQKVENDASPHRERATLLEEQLPLGKASFHIPHAQVGDEGQYQCIITYGDAWDYKYLTLKVKA

SEQ ID NO: 890 - protein, 102 aa, synthetic construct
  REGION 1..102: note = PD-L2 IgV v72
LFTVTVPKELYIVEQGSNVTLECNFDTGSHVNLGAIAASLQKVDNDTCPHRERATLLEEQLPLGKALFHIPQVQVRDEGQYRCIIIYGDAWDYKYLTLKVKA

SEQ ID NO: 891 - protein, 102 aa, synthetic construct
  REGION 1..102: note = PD-L2 IgV v73
LFTVTVPKELYIIEQGSNVTLECNFDTGSHVNHGAITASLQKVENDTSPHRERATLLEEQLPLGKALFHIPQVQVGDEGQYRCIIIYGDAWDYKYLTLKVKA

SEQ ID NO: 892 - protein, 102 aa, synthetic construct
  REGION 1..102: note = PD-L2 IgV v74
LFTVTVPKELYIVEQGSNVTLECNFDTGSHVNLGAITASLQKVENDASPHRERATLLEEQLPLGKASFHIPHVQVGDEGQYQCIITYGVAWDYKYLTLKVKA

SEQ ID NO: 893 - protein, 102 aa, synthetic construct
  REGION 1..102: note = PD-L2 IgV v75
LFTVTVPKELYIIEQGSNVTLECNFDTGSHVNLGAITAILQKVDNDTSPHRERATLLEEQLPLGKASFHIPHVQGGDEGQYRCIIIYGDAWDYKYLTLKVKA

SEQ ID NO: 894 - protein, 102 aa, synthetic construct
  REGION 1..102: note = PD-L2 IgV v76
LFTVTVPKELYIIEQGSNVTLECNFDTGSHVNLGAITASLQKVENDASPHRERATLLEEQLPLGKALFHIPQVQVGDEGQYRCIIIYGDAWDYKYLTLKVKA

SEQ ID NO: 895 - protein, 102 aa, synthetic construct
  REGION 1..102: note = PD-L2 IgV v77
LFTVTVPKELYIVEQGSNVTLECNFDTGSHVNLGAITASLQKVENDASPHRERATLLEEQLPLGKALFHIPHVQVGDEGQYRCIIIYGDAWDYKYLTLKVKA

SEQ ID NO: 896 - protein, 208 aa, synthetic construct
  REGION 1..208: note = CD80 v122 ECD
VIHVTKEVKEVATLSCGHNVSVEELAQTRIYWQKEKKMVLTMMSGDMNIWPEYKNRTIFDITNNLSIVIPALRPSDEGTYECVVLKYEKDAFKREHLAEVTLSVKADFPTPSISDFETPTSNIRRIICSTSGGFPEPHLSWLENGEELSAINTTVSQDPETELYAVSSKLDFNMTTNHSFMCLIKYGHLRVNQTFNWNTTKQEHFPDN

SEQ ID NO: 897 - protein, 208 aa, synthetic construct
  REGION 1..208: note = CD80 v123 ECD
VIHVTKEVKEVATLSCGHNVSVEELAQTRFYWQKEKKMVLTMMSGDMNIWPEYKNRTIFDITNNLSIVIPALRPSDEGTYECVVLKYEKDAFKREHLAEVTLSVKADFPTPSISDFETPTSNIRRIICSTSGGFPEPHLSWLENGEELSAINTTVSQDPETELYAVSSKLDFNMTTNHSFMCLIKYGHLRVNQTFNWNTTKQEHFPDN

SEQ ID NO: 898 - protein, 208 aa, synthetic construct
  REGION 1..208: note = CD80 v124 ECD
VIHVTKEVKEVATLSCGHNVSVEELAHTRIYWQKEKKMVLSMMSGDMNIWPEYKNRTIFDITNNLSIVILDLRPSDEGTYECVVLKYEKDAFKREHLAEVTLSVKADFPTPSISDFETPTSNIRRIICSTSGGFPEPHLSWLENGEELSAINTTVSQDPETELYAVSSKLDFNMTTNHSFMCLIKYGHLRVNQTFNWNTTKQEHFPDN

SEQ ID NO: 899 - protein, 208 aa, synthetic construct
  REGION 1..208: note = CD80 v125 ECD
VIHVTKEVKEVATLSCGHNVSVEELAQTRTYWQKEKKMVLTMMSGDMNIWPEYKNRTIFDITNNLSIVIRALRPSDEGTYECVVLKYEKDAFKREHLAEVTLSVKADFPTPSISDFETPTSNIRRIICSTSGGFPEPHLSWLENGEELSAINTTVSQDPETELYAVSSKLDFNMTTNHSFMCLIKYGHLRVNQTFNWNTTKQEHFPDN

SEQ ID NO: 900 - protein, 208 aa, synthetic construct
  REGION 1..208: note = CD80 v126 ECD
VIHVTKEVKEVARLSRGHNVSVEELAQTRIYWQKEKKMVLTMMSGDMNIWPEYKNRTIFDITNNLSIVIQDLRPSDEGTYECVVLKYEKDAFKREHLAEVTLSVKADFPTPSISDFETPTSNIRRIICSTSGGFPEPHLSWLENGEELSAINTTVSQDPETELYAVSSKLDFNMTTNHSFMCLIKYGHLRVNQTFNWNTTKQEHFPDN

SEQ ID NO: 901 - protein, 208 aa, synthetic construct
  REGION 1..208: note = CD80 v127 ECD
VIHVTKEVKEVATLSCGHNVSVEELAQTRIYWQKEKKMVLTMMSGDMNIWPEYKNRIIFDITNNLSIVILALRPSDEGTYECVVLKYEKDAFKREHLAEVTLSVKADFPTPSISDFETPTSNIRRIICSTSGGFPEPHLSWLENGEELSAINTTVSQDPETELYAVSSKLDFNMTTNHSFMCLIKYGHLRVNQTFNWNTTKQEHFPDN

SEQ ID NO: 902 - protein, 208 aa, synthetic construct
  REGION 1..208: note = CD80 v128 ECD
VIHVTKEVKEVATLSCGHNVSVEELAQTRIYWQKEKKMVLTMISGDMNIWPEYKNRTIFDITNNLSIVILALRPSDEGTYERVVLKYEKDAFKREHLAEVTLSVKADFPTPSISDFETPTSNIRRIICSTSGGFPEPHLSWLENGEELSAINTTVSQDPETELYAVSSKLDFNMTTNHSFMCLIKYGHLRVNQTFNWNTTKQEHFPDN

SEQ ID NO: 903 - protein, 208 aa, synthetic construct
  REGION 1..208: note = CD80 v130 ECD
VIHVTKEVKEVATLSCGHNVSLEELAQTRIYWQKEKKVVLTMMSGDTNIWPEYKNRTIFDITNNLSIVILDLRPSDEGTYECVVMKYEKDAFKREHLAEVTLSVKADFPTPSISDFETPTSNIRRIICSTSGGFPEPHLSWLENGEELSAINTTVSQDPETELYAVSSKLDFNMTTNHSFMCLIKYGHLRVNQTFNWNTTKQEHFPDN

SEQ ID NO: 904 - protein, 208 aa, synthetic construct
  REGION 1..208: note = CD80 v131 ECD
VIHVTKEVKEVATLSCGHNVSVEELAQTRVYWQKEKKMVLTMMSGDMNIWPEYKNRIIFDITNNLSIVIPDLRPSDEGTYECVVLKYEKDTFKREHLAEVTLSVKADFPTPSISDFETPTSNIRRIICSTSGGFPEPHLSWLENGEELSAINTTVSQDPETELYAVSSKLDFNMTTNHSFMCLIKYGHLRVNQTFNWNTTKQEHFPDN

SEQ ID NO: 905 - protein, 208 aa, synthetic construct
  REGION 1..208: note = CD80 v132 ECD
VIHVTKEVKEVATLSCGHNVSIEELAQTRIYWQKEKKMVLTMMSGDMNIWPEYKNRTIFDITNNLSIVIMDLRPSDEGTYECVVLKYEKDAFKREHLAEVTLSVKADFPTPSISDFETPTSNIRRIICSTSGGFPEPHLSWLENGEELSAINTTVSQDPETELYAVSSKLDFNMTTNHSFMCLIKYGHLRVNQTFNWNTTKQEHFPDN

SEQ ID NO: 906 - protein, 208 aa, synthetic construct
  REGION 1..208: note = CD80 v133 ECD
VIHVTKEVKEVATLSCGHNVSVEELAQTRIYWQKEKKMVLTMMSGDMNIWPEYKDRTIFDITNNLSIVIPALRPSDGGTYECVVLKYEKDAFKREHLAEVTLSVKADFPTPSISDFETPTSNIRRIICSTSGGFPEPHLSWLENGEELSAINTTVSQDPETELYAVSSKLDFNMTTNHSFMCLIKYGHLRVNQTFNWNTTKQEHFPDN

SEQ ID NO: 907 - protein, 208 aa, synthetic construct
  REGION 1..208: note = CD80 v134 ECD
VIHVTKEVKEVATLSCGHNVSVEELAQTRIYWQKEKKMVLTMMSGDMNIWPEYKNRAIFDITNNLSIVTLALRPSDEGTYECVVLKYEKDAFKREHLAEVTLSVKADFPTPSISDFETPTSNIRRIICSTSGGFPEPHLSWLENGEELSAINTTVSQDPETELYAVSSKLDFNMTTNHSFMCLIKYGHLRVNQTFNWNTTKQEHFPDN

SEQ ID NO: 908 - protein, 208 aa, synthetic construct
  REGION 1..208: note = CD80 v135 ECD
VIHVTKEVKEVATLSCGHNVSVEELAQTRIYWQKEKKMVLTMMSGDMNIWPEYKDRTIFDITNNLSIVILALRPSDEGTYECVVLMYEKDAFKREHLAEVTLSVKADFPTPSISDFETPTSNIRRIICSTSGGFPEPHLSWLENGEELSAINTTVSQDPETELYAVSSKLDFNMTTNHSFMCLIKYGHLRVNQTFNWNTTKQEHFPDN

SEQ ID NO: 909 - protein, 208 aa, synthetic construct
  REGION 1..208: note = CD80 v136 ECD
VIHVTKEVKEVATLSCGHNVSVEELAQTRIYWQKEKKMVLTMMSGDMNIWPEYKNRTIFDITNNLSIVILAPRPSDEGIYECVVLKYEKDAFKREHLAEVTLSVKADFPTPSISDFETPTSNIRRIICSTSGGFPEPHLSWLENGEELSAINTTVSQDPETELYAVSSKLDFNMTTNHSFMCLIKYGHLRVNQTFNWNTTKQEHFPDN

SEQ ID NO: 910 - protein, 208 aa, synthetic construct
  REGION 1..208: note = CD80 v137 ECD
VIHVTKEVKEVATLSCGHNVSVEELAQTRIYWQKEKKMVLTMMSGDMNIWPEYKNRTIFDITNNLSIVIPALRPSDEGTYECVVLKYEKDASKREHLAEVTLSVKADFPTPSISDFETPTSNIRRIICSTSGGFPEPHLSWLENGEELSAINTTVSQDPETELYAVSSKLDFNMTTNHSFMCLIKYGHLRVNQTFNWNTTKQEHFPDN

SEQ ID NO: 911 - protein, 208 aa, synthetic construct
  REGION 1..208: note = CD80 v138 ECD
VIHVTKEVKEVATLSCGHNVSVEELAQTRIYWQKEKKMVLTMMSGDMNIWPEYKNRTIFDITNNLSIVILALRPSDEGPYECVVLKYEKDAFKREHLAEVTLSVKADFPTPSISDFETPTSNIRRIICSTSGGFPEPHLSWLENGEELSAINTTVSQDPETELYAVSSKLDFNMTTNHSFMCLIKYGHLRVNQTFNWNTTKQEHFPDN

SEQ ID NO: 912 - protein, 208 aa, synthetic construct
  REGION 1..208: note = CD80 v139 ECD
VIHVTKEVKEVATLSCGHNVSVEELAQTRIYWQKDKKMVLTMMSGDINIWPEYKNRTIFDITNNPSIVILALRPSDEGTYECVVLKYEKNAFKREHLAEVTLSVKADFPTPSISDFETPTSNIRRIICSTSGGFPEPHLSWLENGEELSAINTTVSQDPETELYAVSSKLDFNMTTNHSFMCLIKYGHLRVNQTFNWNTTKQEHFPDN

SEQ ID NO: 913 - protein, 208 aa, synthetic construct
  REGION 1..208: note = CD80 v140 ECD
VIHVTKEVKEVATLSCGHNVSVEESAQTRIYWQKDKKMVLTMMSGDINIWPEYKNRTIFDITNNLSIVILALRPSDEGTYECVVLKYEKNAFKREHLAEVTLSVKADFPTPSISDFETPTSNIRRIICSTSGGFPEPHLSWLENGEELSAINTTVSQDPETELYAVSSKLDFNMTTNHSFMCLIKYGHLRVNQTFNWNTTKQEHFPDN

SEQ ID NO: 914 - protein, 208 aa, synthetic construct
  REGION 1..208: note = CD80 v141 ECD
  VARIANT 27: note = Xaa = unknown
VIHVTKEVKEVATLSCGHNVSVEELAXTRIYWQKEKKMVLTMMPGDMNIWPEYKNRTIFDITNNLSTVILALRSSDEGTYGCVVLKYEKDAFKRDHLAEVTLSVKADFPTPSISDFETPTSNIRRIICSTSGGFPEPHLSWLENGEELSAINTTVSQDPETELYAVSSKLDFNMTTNHSFMCLIKYGHLRVNQTFNWNTTKQEHFPDN

SEQ ID NO: 915 - protein, 208 aa, synthetic construct
  REGION 1..208: note = CD80 v142 ECD
VIHVTKEVKEVATLSCGHNVSVEELAQTRIYWQKEKKMVLTMMSGDMNIWPEYKNRTIFDITNNLSIVILDLRPSDEGTYECVVLKYEKDAFKREHLAEVTLSVKADFPTPSISDFETPTSNIRRIICSTSGGFPEPHLSWLENGEELSAINTTVSQDPETELYAVSSKLDFNMTTNHSFMCLIKYGHLRVNQTFNWNTTKQEHFPDN

SEQ ID NO: 916 - protein, 208 aa, synthetic construct
  REGION 1..208: note = CD80 v143 ECD
  VARIANT 27: note = Xaa = unknown
VIHVTKEVKEVAALSCGHNVSVEELAXTRIYWQKEKKMVLTMMSGDMNIWPEYKNRTIFDNTNNLSIVILDLRPSDEGTYECVVLKYEKDAFKREHLAEVTLSVKADFPTPSISDFETPTSNIRRIICSTSGGFPEPHLSWLENGEELSAINTTVSQDPETELYAVSSKLDFNMTTNHSFMCLIKYGHLRVNQTFNWNTTKQEHFPDN

SEQ ID NO: 917 - protein, 208 aa, synthetic construct
  REGION 1..208: note = CD80 v144 ECD
VIHVTKEVKEVATLSCGHNVSVEELAQTRIYWQKEKKMVLTMMSGDMNIWPEYKNRTIFDITNNLSIVILALRPSDEGTYKCVVLKYEKDSFKREHLAEVTLSVKADFPTPSISDFETPTSNIRRIICSTSGGFPEPHLSWLENGEELSAINTTVSQDPETELYAVSSKLDFNMTTNHSFMCLIKYGHLRVNQTFNWNTTKQEHFPDN

SEQ ID NO: 918 - protein, 208 aa, synthetic construct
  REGION 1..208: note = CD80 v145 ECD
VIHVTKEVKEVVTLSCGHNVSVEELAQTRIYWQKEKKMVLTMMSGDVNIWPEYKNRTIFDITNNLSIVIMALRPSDEGTYECVVLKYEKDAFKREHLAEVTLSVKADFPTPSISDFETPTSNIRRIICSTSGGFPEPHLSWLENGEELSAINTTVSQDPETELYAVSSKLDFNMTTNHSFMCLIKYGHLRVNQTFNWNTTKQEHFPDN

SEQ ID NO: 919 - protein, 208 aa, synthetic construct
  REGION 1..208: note = CD80 v146 ECD
VIHVTKEVKEVATLSCGHNVSVEELAQTRIYWQEEKKMVLAMMSGDMNIWPEYKNRTIFDITNNLSIVILAVRPSDEGTYECVVLKYEKDAFKREHLAEVTLSVKADFPTPSISDFETPTSNIRRIICSTSGGFPEPHLSWLENGEELSAINTTVSQDPETELYAVSSKLDFNMTTNHSFMCLIKYGHLRVNQTFNWNTTKQEHFPDN

SEQ ID NO: 920 - protein, 208 aa, synthetic construct
  REGION 1..208: note = CD80 v147 ECD
VIHVTKEVKEVATLSCGHNVSVEELAQTRIYWQKEKKMVLSMMSGDMNIWPEYKNRTIFDITNNLSIVILDLRPSDEGTYECVALKYEKDAFKREHLAEVTLSVKADFPTPSISDFETPTSNIRRIICSTSGGFPEPHLSWLENGEELSAINTTVSQDPETELYAVSSKLDFNMTTNHSFMCLIKYGHLRVNQTFNWNTTKQEHFPDN

SEQ ID NO: 921 - protein, 208 aa, synthetic construct
  REGION 1..208: note = CD80 v148 ECD
VIHVTKEVKEVATLSCGHNVSVEELAQTRIYWQKDKKMVLTMMSGDMNIWPEYKNRTIFDITNNLSIVILDLRPSDEGTYECVVLKYEKDAFKREHLAEVTLSVKADFPTPSISDFETPTSNIRRIICSTSGGFPEPHLSWLENGEELSAINTTVSQDPETELYAVSSKLDFNMTTNHSFMCLIKYGHLRVNQTFNWNTTKQEHFPDN

SEQ ID NO: 922 - protein, 208 aa, synthetic construct
  REGION 1..208: note = CD80 v149 ECD
VIHVTKEVKEVATLSCGHNVSVEELAQTRIYWQKDKKMVLTMMSGDINIWPEYKNRTIFDITNNLSIVILALRPSDEGTYECVVLKYEKDAFKREHLAEVTLSVKADFPTPSISDFETPTSNIRRIICSTSGGFPEPHLSWLENGEELSAINTTVSQDPETELYAVSSKLDFNMTTNHSFMCLIKYGHLRVNQTFNWNTTKQEHFPDN

SEQ ID NO: 923 - protein, 208 aa, synthetic construct
  REGION 1..208: note = CD80 v150 ECD
VIHVTKEVKEVATLSCGHNVSVEELAQTRIYWQKERKMVLTMMSGDMNIWPEYKNRTIFDITNNLSIVILALRPSDEATYECVVLKYEKDAFKREHLAEVTLSVKADFPTPSISDFETPTSNIRRIICSTSGGFPEPHLSWLENGEELSAINTTVSQDPETELYAVSSKLDFNMTTNHSFMCLIKYGHLRVNQTFNWNTTKQEHFPDN

SEQ ID NO: 924 - protein, 208 aa, synthetic construct
  REGION 1..208: note = CD80 v151 ECD
VIHVTKEVKEVATLSCGHNVSVEELAQTRIYWEKEKKMVLAMMSGDMNIWPEYKNRTIFDITNNLSIVILALRPSDEGTYECVVLKYEKDAFKREHLAEVTLSVKADFPTPSISDFETPTSNIRRIICSTSGGFPEPHLSWLENGEELSAINTTVSQDPETELYAVSSKLDFNMTTNHSFMCLIKYGHLRVNQTFNWNTTKQEHFPDN

SEQ ID NO: 925 - protein, 208 aa, synthetic construct
  REGION 1..208: note = CD80 v152 ECD
VIHVTKEVKEVATLSCGHNVSVEELAQTRIYWQKEKKMVLTMMSGDVHIWPEYKNRTIFDITNNLSIVILALRPSDEGTYECVVLKYEKDAFKREHLAEVTLSVKADFPTPSISDFETPTSNIRRIICSTSGGFPEPHLSWLENGEELSAINTTVSQDPETELYAVSSKLDFNMTTNHSFMCLIKYGHLRVNQTFNWNTTKQEHFPDN

SEQ ID NO: 926 - protein, 208 aa, synthetic construct
  REGION 1..208: note = CD80 v153 ECD
VIHVTKEVKEVATLSCGHNVSVEELAQTRIYWQKEKKMVLTMMSGDLNIWPEYKNRTIFDITNNLSIAILALRPSDEGTYECVVLKYEKDAFKREHLAEVTLSVKADFPTPSISDFETPTSNIRRIICSTSGGFPEPHLSWLENGEELSAINTTVSQDPETELYAVSSKLDFNMTTNHSFMCLIKYGHLRVNQTFNWNTTKQEHFPDN

SEQ ID NO: 927 - protein, 208 aa, synthetic construct
  REGION 1..208: note = CD80 v154 ECD
VIHVTKEVKEVATLSCGHNVSVEELAQTRIYWQKEKKMVLTMMPGDMNIWPEYKNRTIFDITNNLSIVILDLRPSDEGTYECVVLKYEKDAFKREHLAEVTLSVKADFPTPSISDFETPTSNIRRIICSTSGGFPEPHLSWLENGEELSAINTTVSQDPETELYAVSSKLDFNMTTNHSFMCLIKYGHLRVNQTFNWNTTKQEHFPDN

SEQ ID NO: 928 - protein, 208 aa, synthetic construct
  REGION 1..208: note = CD80 v155 ECD
VIHVTKEVKEVATLSCGHNVSVEELAHTRIYWQKEKKMVLTMISGDMNIWPEYKNRTIFDITNNLSIVILDLSPSDEGTYECVVLKYEKDAFKREHLAEVTLSVKADFPTPSISDFETPTSNIRRIICSTSGGFPEPHLSWLENGEELSAINTTVSQDPETELYAVSSKLDFNMTTNHSFMCLIKYGHLRVNQTFNWNTTKQEHFPDN

SEQ ID NO: 929 - protein, 208 aa, synthetic construct
  REGION 1..208: note = CD80 v156 ECD
  VARIANT 24: note = Xaa = unknown
VIHVTKEVKEVATLSCGHNVSVEXLAQTRIYWRKEKKMVLTMMSGDMNIWPEYNNRIIFDITNNLSVVILDLRPSDEGTYECVVLKYEKDAFKREHLAEVTLSVKADFPTPSISDFETPTSNIRRIICSTSGGFPEPHLSWLENGEELSAINTTVSQDPETELYAVSSKLDFNMTTNHSFMCLIKYGHLRVNQTFNWNTTKQEHFPDN

SEQ ID NO: 930 - protein, 208 aa, synthetic construct
  REGION 1..208: note = CD80 v157 ECD
VIHVTKEVKEVATLSCGHNVSVEELAQTRIYWQKDKKMVLTMMSGDMNIWPEYKNRIIFDITNNLSIVIQDLRPSDEGTYECVVLKYEKDAFKREHLAEVTLSVKADFPTPSISDFETPTSNIRRIICSTSGGFPEPHLSWLENGEELSAINTTVSQDPETELYAVSSKLDFNMTTNHSFMCLIKYGHLRVNQTFNWNTTKQEHFPDN

SEQ ID NO: 931 - protein, 208 aa, synthetic construct
  REGION 1..208: note = CD80 v158 ECD
VIHVTKEVKEVATLSCGHNVSVEELAQTRIYWQKEKKMVLTMMSGDINIWPEYKNRTIFDITNNLSIVILALRPSDEGTYECVVLKYDKDAFKREHLAEVTLSVKADFPTPSISDFETPTSNIRRIICSTSGGFPEPHLSWLENGEELSAINTTVSQDPETELYAVSSKLDFNMTTNHSFMCLIKYGHLRVNQTFNWNTTKQEHFPDN

SEQ ID NO: 932 - protein, 208 aa, synthetic construct
  REGION 1..208: note = CD80 v159 ECD
VIHVTKEVKEVATLSCGHNVSVEELAQTRIYWQKEKKMVLTIMSGDMNIWPEYKNRTIFDVTNNLSIVILDLRPSDEGTYECVVLKYEKDAFKREHLAEVTLSVKADFPTPSISDFETPTSNIRRIICSTSGGFPEPHLSWLENGEELSAINTTVSQDPETELYAVSSKLDFNMTTNHSFMCLIKYGHLRVNQTFNWNTTKQEHFPDN

SEQ ID NO: 933 - protein, 208 aa, synthetic construct
  REGION 1..208: note = CD80 v160 ECD
VIHVTKEVKEVATLSCGHNVSVEELAQTRIYWQKEKKMVLTMMSGDMNIWAEYKNRTIFDITNNLSIVILDLRPSDEGTYECVVLKYEKDAFKREHLAEVTLSVKADFPTPSISDFETPTSNIRRIICSTSGGFPEPHLSWLENGEELSAINTTVSQDPETELYAVSSKLDFNMTTNHSFMCLIKYGHLRVNQTFNWNTTKQEHFPDN

SEQ ID NO: 934 - protein, 208 aa, synthetic construct
  REGION 1..208: note = CD80 v161 ECD
VIHVTKEVKEVATLSCGYNVSVEELAQTRIYWQKEKKMVLTMMSGDINIWPEYKNRIIFDITNNLSIVILGLRPSDEGTYECVVLKYEKDAFKREHLAEVTLSVKADFPTPSISDFETPTSNIRRIICSTSGGFPEPHLSWLENGEELSAINTTVSQDPETELYAVSSKLDFNMTTNHSFMCLIKYGHLRVNQTFNWNTTKQEHFPDN

SEQ ID NO: 935 - protein, 208 aa, synthetic construct
  REGION 1..208: note = CD80 v162 ECD
VIHVTKEVKEVATLSCGHNISVEELAQTRIYWQKEKKMVLTMMSGDVNIWPEYKNRIIFDITNNLSIVILALRPSDEGTYECVILKYEKDAFKREHLAEVTLSVKADFPTPSISDFETPTSNIRRIICSTSGGFPEPHLSWLENGEELSAINTTVSQDPETELYAVSSKLDFNMTTNHSFMCLIKYGHLRVNQTFNWNTTKQEHFPDN

SEQ ID NO: 936 - protein, 208 aa, synthetic construct
  REGION 1..208: note = CD80 v163 ECD
VIHVTKEVKEVATLSCGHNISVEELAQTRIYWQKEKKMVLTMMSGDVNIWPEYKNRTIFDITNNLSIVILDLRPSDEGTYECVVLKYEKDAFKREHLAEVTLSVKADFPTPSISDFETPTSNIRRIICSTSGGFPEPHLSWLENGEELSAINTTVSQDPETELYAVSSKLDFNMTTNHSFMCLIKYGHLRVNQTFNWNTTKQEHFPDN

SEQ ID NO: 937 - protein, 208 aa, synthetic construct
  REGION 1..208: note = CD80 v164 ECD
VIHVTKEVKEVATLSCGHNVSVEELAQTRIYWQKEKKMVLTMMSGDMNIWPEYKNRTIFDITNNLSIVILDVRPSDEGTYECVVLKYEKDAFKRKHLAEVTLSVKADFPTPSISDFETPTSNIRRIICSTSGGFPEPHLSWLENGEELSAINTTVSQDPETELYAVSSKLDFNMTTNHSFMCLIKYGHLRVNQTFNWNTTKQEHFPDN

SEQ ID NO: 938 - protein, 208 aa, synthetic construct
  REGION 1..208: note = CD80 v165 ECD
VIHVTKEVKEVATLSCGHNVSLEELAQTRIYWQKGKKMVLTMMSGDMNIWPEYKNRTIFDITNNLSIVILDPRPSDEGTYECVVLKYEKDAFKREHLAEVTLSVKADFPTPSISDFETPTSNIRRIICSTSGGFPEPHLSWLENGEELSAINTTVSQDPETELYAVSSKLDFNMTTNHSFMCLIKYGHLRVNQTFNWNTTKQEHFPDN

SEQ ID NO: 939 - protein, 208 aa, synthetic construct; identical to SEQ ID NO: 921
  REGION 1..208: note = CD80 v166 ECD

SEQ ID NO: 940 - protein, 208 aa, synthetic construct
  REGION 1..208: note = CD80 v167 ECD
VIHVTKEVKEVATLSCGHNVSVEELAQTRIYWQKDKKMVLTMMSGDMNIWPEYKNRTIFDITNNLSLVILDLRPSDEGTYECVVLKYEKDAFKREHLAEVTLSVKADFPTPSISDFETPTSNIRRIICSTSGGFPEPHLSWLENGEELSAINTTVSQDPETELYAVSSKLDFNMTTNHSFMCLIKYGHLRVNQTFNWNTTKQEHFPDN

SEQ ID NO: 941 - protein, 208 aa, synthetic construct
  REGION 1..208: note = CD80 v168 ECD
VIHVTKEVKEVATLSCGHNVSVEELAHTRIYWQKGKKMVLTMMSGDMNIWPEYKNRTIFDITNNLSIVILDPRPSDEGIYECVVLKYEKDAFKREHLAEVTLSVKADFPTPSISDFETPTSNIRRIICSTSGGFPEPHLSWLENGEELSAINTTVSQDPETELYAVSSKLDFNMTTNHSFMCLIKYGHLRVNQTFNWNTTKQEHFPDN

SEQ ID NO: 942 - protein, 208 aa, synthetic construct
  REGION 1..208: note = CD80 v169 ECD
VIHVTKEVKEVARLSCGHNVSVEELAQTRIYWQKEKKMVLTVMSGDINIWPEYKNRTIFDITNNLSIVILDLRPSDEGTYECVVLKYEKDAFKREHLAEVTLSVKADFPTPSISDFETPTSNIRRIICSTSGGFPEPHLSWLENGEELSAINTTVSQDPETELYAVSSKLDFNMTTNHSFMCLIKYGHLRVNQTFNWNTTKQEHFPDN

SEQ ID NO: 943 - protein, 208 aa, synthetic construct
  REGION 1..208: note = CD80 v170 ECD
VIHVTKEVKEVATLSCGHNVSVEELAQTRIYWQKDKKMVLTMMSGDMNIWPEYKNRTIFDITNNLSIVILALRPSDEGTYECVVLKYEKDAFKREHLAEVTLSVKADFPTPSISDFETPTSNIRRIICSTSGGFPEPHLSWLENGEELSAINTTVSQDPETELYAVSSKLDFNMTTNHSFMCLIKYGHLRVNQTFNWNTTKQEHFPDN

SEQ ID NO: 944 - protein, 208 aa, synthetic construct
  REGION 1..208: note = CD80 v171 ECD
VIHVTKEVKEVATLSCGHNVSVEELAQTRIYWQKDKKMVLTMMSGDINIWPEYKNRTIFDITNNLSIVIMALRPSDEGTYECVVLKYEKDAFKREHLAEVTLSVKADFPTPSISDFETPTSNIRRIICSTSGGFPEPHLSWLENGEELSAINTTVSQDPETELYAVSSKLDFNMTTNHSFMCLIKYGHLRVNQTFNWNTTKQEHFPDN

SEQ ID NO: 945 - protein, 208 aa, synthetic construct
  REGION 1..208: note = CD80 v172 ECD
VIHVTKEVKEVATLSCGHNVSVEELAQTRIYWQKDKKMVLTMMSGDMNIWPEYKNRTIFDITNNLSIVILDVRPSDEGTYECVVLKYEKDAFKREHLAEVTLSVKADFPTPSISDFETPTSNIRRIICSTSGGFPEPHLSWLENGEELSAINTTVSQDPETELYAVSSKLDFNMTTNHSFMCLIKYGHLRVNQTFNWNTTKQEHFPDN

SEQ ID NO: 946 - protein, 208 aa, synthetic construct
  REGION 1..208: note = CD80 v173 ECD
VIHVTKEVKEVATLSCGHNVSVEELAQTRIYWQKDKKMVLTMLSGDMNIWPEYKNRTIFDITNNLSIVIMALRPSDEGTYECVVLKYEKDAFKREHLAEVTLSVKADFPTPSISDFETPTSNIRRIICSTSGGFPEPHLSWLENGEELSAINTTVSQDPETELYAVSSKLDFNMTTNHSFMCLIKYGHLRVNQTFNWNTTKQEHFPDN

SEQ ID NO: 947 - protein, 208 aa, synthetic construct
  REGION 1..208: note = CD80 v174 ECD
VIHVTKEVKEVATLSCGHNVSVEELPQTRIYWQKDKKMVLTMISGDMNIWPEYKNRTIFDITNNLSIVILALRPSDEGTYECVVQKYDKDAFKREHLAEVTLSVKADFPTPSISDFETPTSNIRRIICSTSGGFPEPHLSWLENGEELSAINTTVSQDPETELYAVSSKLDFNMTTNHSFMCLIKYGHLRVNQTFNWNTTKQEHFPDN

SEQ ID NO: 948 - protein, 208 aa, synthetic construct
  REGION 1..208: note = CD80 v175 ECD
VIHVTKEVKEVATLSCGHNVSVEELAQTRIYWQKDKKMVLTMMSGVMNIWPEYKNRTIFDITNNLSIVILALRPSDEGTYECVVQKYEKDAFKREHLAEVTLSVKADFPTPSISDFETPTSNIRRIICSTSGGFPEPHLSWLENGEELSAINTTVSQDPETELYAVSSKLDFNMTTNHSFMCLIKYGHLRVNQTFNWNTTKQEHFPDN

SEQ ID NO: 949 - protein, 208 aa, synthetic construct
  REGION 1..208: note = CD80 v176 ECD
VIHVTKEVKEVATLSCGHNVSVEELALTRIYWQKDKKMVLTMMSGDINIWPEYKNRIIFDITNNLSIVIQALRPSDEGTYECVVLKYDKDAFKREHLAEVTLSVKADFPTPSISDFETPTSNIRRIICSTSGGFPEPHLSWLENGEELSAINTTVSQDPETELYAVSSKLDFNMTTNHSFMCLIKYGHLRVNQTFNWNTTKQEHFPDN

SEQ ID NO: 950 - protein, 208 aa, synthetic construct
  REGION 1..208: note = CD80 v177 ECD
VIHVTKEVKEVATLSCGHNVSVEELAQTRIYWQKEKKMVLTMMSGDVNIWPEYKNRTIFDITNNLSIVFLDLRPSDEGTYECIVLKYEKDAFKREHLAEVTLSVKADFPTPSISDFETPTSNIRRIICSTSGGFPEPHLSWLENGEELSAINTTVSQDPETELYAVSSKLDFNMTTNHSFMCLIKYGHLRVNQTFNWNTTKQEHFPDN

SEQ ID NO: 951 - protein, 208 aa, synthetic construct
  REGION 1..208: note = CD80 v178 ECD
VIHVTKEVKEVATLSCGHNVSVEELAQTRIYWQKDKKMVLTMMSGDMNIWPEYKNRAIFDITNNLSIVILDLRPSDEGTYECVVQKYEKDAFKREHLAEVTLSVKADFPTPSISDFETPTSNIRRIICSTSGGFPEPHLSWLENGEELSAINTTVSQDPETELYAVSSKLDFNMTTNHSFMCLIKYGHLRVNQTFNWNTTKQEHFPDN

SEQ ID NO: 952 - protein, 208 aa, synthetic construct
  REGION 1..208: note = CD80 v179 ECD
VIHVTKEVKEVATLSCGYNVSVEELTQTRIYWQKDKKMVLTMMSGDMNIWPEYKNRTIFDITNNLSIVILDLRPSDEGTYECVVQKYEKDAFKREHLAEVTLSVKADFPTPSISDFETPTSNIRRIICSTSGGFPEPHLSWLENGEELSAINTTVSQDPETELYAVSSKLDFNMTTNHSFMCLIKYGHLRVNQTFNWNTTKQEHFPDN

SEQ ID NO: 953 - protein, 208 aa, synthetic construct
  REGION 1..208: note = CD80 v180 ECD
VIHVTKEVKEVATLSCGHNVSVEELAQTRIYWQKDKKMVLTMMSGDLNIWPEYKNRTIFDITNNLSIVILALRPSDEGTYECVVLKYEKDAFKREHLAEVTLSVKADFPTPSISDFETPTSNIRRIICSTSGGFPEPHLSWLENGEELSAINTTVSQDPETELYAVSSKLDFNMTTNHSFMCLIKYGHLRVNQTFNWNTTKQEHFPDN

SEQ ID NO: 954 - protein, 208 aa, synthetic construct
  REGION 1..208: note = CD80 v181 ECD
VIHVTKEVKEVATLSCGHNVSVDELAQTRIYWQKEKKMVLTVISGDMNIWPEYKNRTVFDITNNLSIVIRALRPSDEGTYECVVLKYEKDAFKREHLAEVTLSVKADFPTPSISDFETPTSNIRRIICSTSGGFPEPHLSWLENGEELSAINTTVSQDPETELYAVSSKLDFNMTTNHSFMCLIKYGHLRVNQTFNWNTTKQEHFPDN

SEQ ID NO: 955 - protein, 208 aa, synthetic construct
  REGION 1..208: note = CD80 v182 ECD
VIHVTKEVKEVATLSCGHNVSVEELAQTRIYWQKEKKMVLTMMSGDMNIWPEYKNRTIFDITNNLSIMIMDLRPSDEGTYECVVLKYEKDAFKRKHLAEVTLSVKADFPTPSISDFETPTSNIRRIICSTSGGFPEPHLSWLENGEELSAINTTVSQDPETELYAVSSKLDFNMTTNHSFMCLIKYGHLRVNQTFNWNTTKQEHFPDN

SEQ ID NO: 956 - protein, 208 aa, synthetic construct
  REGION 1..208: note = CD80 v183 ECD
VIHVTKEVKEVATLSCGHNVSVEELAQTRIYWQKEKKMVLTMMSGDMNIWPEYKIRIIFDITNNLSIVFLALRPSDEGTYECVVLKYEKDAFKREHLAEVTLSVKADFPTPSISDFETPTSNIRRIICSTSGGFPEPHLSWLENGEELSAINTTVSQDPETELYAVSSKLDFNMTTNHSFMCLIKYGHLRVNQTFNWNTTKQEHFPDN

SEQ ID NO: 957 - protein, 208 aa, synthetic construct
  REGION 1..208: note = CD80 v184 ECD
VIHVTKEVKEVATLSCGHNVSVEELAQTRIYWQKDKKMVLTMISGDMNIWPEYKNRTIFDITNNLSIVILDLRPSDEGTYECVVLKYEKDAFKREHLAEVTLSVKADFPTPSISDFETPTSNIRRIICSTSGGFPEPHLSWLENGEELSAINTTVSQDPETELYAVSSKLDFNMTTNHSFMCLIKYGHLRVNQTFNWNTTKQEHFPDN

SEQ ID NO: 958 - protein, 208 aa, synthetic construct
  REGION 1..208: note = CD80 v185 ECD
VIHVTKEVKEVATLSCGHNVSVEELAQTRIYWQKEKKMVLSMMSGDMNIWPEYKNRIIFDITNNLSIVIRALRPSDEGTYECVVLKYEKDAFKREHLAEVTLSVKADFPTPSISDFETPTSNIRRIICSTSGGFPEPHLSWLENGEELSAINTTVSQDPETELYAVSSKLDFNMTTNHSFMCLIKYGHLRVNQTFNWNTTKQEHFPDN

SEQ ID NO: 959 - protein, 208 aa, synthetic construct
  REGION 1..208: note = CD80 v186 ECD
VIHVTKEVKEVATLSCGYNVSVEELAQTRIYWQKEKKMVLTMMSGDMNIWPEYKNRTIFDITNNLSIVILDPRPSDEGTYECVVLKYVKDAFKREHLAEVTLSVKADFPTPSISDFETPTSNIRRIICSTSGGFPEPHLSWLENGEELSAINTTVSQDPETELYAVSSKLDFNMTTNHSFMCLIKYGHLRVNQTFNWNTTKQEHFPDN

SEQ ID NO: 960 - protein, 208 aa, synthetic construct
  REGION 1..208: note = CD80 v187 ECD
VIHVTKEVKEVATLSCGHNISVEELAQTRIYWQKEKKMVLTMMSGDMNIWPEYKNRTIFDITNNLSIVILDLRPSDEGTYECVVLKYEKDAFKREHLAEVTLSVKADFPTPSISDFETPTSNIRRIICSTSGGFPEPHLSWLENGEELSAINTTVSQDPETELYAVSSKLDFNMTTNHSFMCLIKYGHLRVNQTFNWNTTKQEHFPDN

SEQ ID NO: 961 - protein, 208 aa, synthetic construct
  REGION 1..208: note = CD80 v188 ECD
VIHVTKEVKEVATLSCGHNVSVGELSQTRIYWQKDKKMVLTMMSGDMNIWPEYKNRTIFDINNNLSIVILDVRPSDEGTYECVVMKYEKDAFKREHLAEVTLSVKADFPTPSISDFETPTSNIRRIICSTSGGFPEPHLSWLENGEELSAINTTVSQDPETELYAVSSKLDFNMTTNHSFMCLIKYGHLRVNQTFNWNTTKQEHFPDN

SEQ ID NO: 962 - protein, 208 aa, synthetic construct
  REGION 1..208: note = CD80 v189 ECD
VIHVTKEVKEVTTLSCGHNVSVEDLAQTRIYWQKDKKMVLTMMSGVMNIWPEYKNRTIFDVTNNLSIVILAPRPSDEGTYECVVLKYEKDAFKRVHLAEVTLSVKADFPTPSISDFETPTSNIRRIICSTSGGFPEPHLSWLENGEELSAINTTVSQDPETELYAVSSKLDFNMTTNHSFMCLIKYGHLRVNQTFNWNTTKQEHFPDN

SEQ ID NO: 963 - protein, 208 aa, synthetic construct
  REGION 1..208: note = CD80 v190 ECD
VIHVTKEVKEVATLSCGHNVSLEELAQTRIYWQKDKKMVLTMLSGDMNIWPEYKNRTIFDITNNLSIVILGLRPSHEGTYECVVLKYEKDAFKREHLAEVTLSVKADFPTPSISDFETPTSNIRRIICSTSGGFPEPHLSWLENGEELSAINTTVSQDPETELYAVSSKLDFNMTTNHSFMCLIKYGHLRVNQTFNWNTTKQEHFPDN

SEQ ID NO: 964 - protein, 208 aa, synthetic construct
  REGION 1..208: note = CD80 v191 ECD
VIHVTKEVKEVATLSCGHNVSVEELAQTRIYWQKGKKMVLTMMSGDMNIWPEYENRTIFDITNNLSIVILDPRPSDEGTYECVVLKYEKDAFKREHLAEVTLSVKADFPTPSISDFETPTSNIRRIICSTSGGFPEPHLSWLENGEELSAINTTVSQDPETELYAVSSKLDFNMTTNHSFMCLIKYGHLRVNQTFNWNTTKQEHFPDN

SEQ ID NO: 965 - protein, 208 aa, synthetic construct
  REGION 1..208: note = CD80 v192 ECD
VIHVTKEVKEVATLSCGHNVSVEELAQTRIYWQKEKKMVLTMMSGDMNIWPEYKNRTIFDITNNLSIVIQDLRPSDEGTYECVVLKYEKDAFKREHLAEVTLSVKADFPTPSISDFETPTSNIRRIICSTSGGFPEPHLSWLENGEELSAINTTVSQDPETELYAVSSKLDFNMTTNHSFMCLIKYGHLRVNQTFNWNTTKQEHFPDN

SEQ ID NO: 966 - protein, 208 aa, synthetic construct
  REGION 1..208: note = CD80 v193 ECD
VIHVTKEVKEVATLSCGHNVSVEELEQTRIYWQKDKKMVLTMMSGDLNIWPEYKNRTIFDITNNLSIVILALRPSDEGTYECVVQKYEKDAFKREHLAEVTLSVKADFPTPSISDFETPTSNIRRIICSTSGGFPEPHLSWLENGEELSAINTTVSQDPETELYAVSSKLDFNMTTNHSFMCLIKYGHLRVNQTFNWNTTKQEHFPDN

SEQ ID NO: 967 - protein, 208 aa, synthetic construct
  REGION 1..208: note = CD80 v194 ECD
VIHVTKEVKEVATLSCGHNVSVEELAQTRIYWQKEKKMVLTMMSGEMNIWPEYKNRTIFDITNNLSIVILDLRPSDEGTYECVVLKYEKDAFKREHLAEVTLSVKADFPTPSISDFETPTSNIRRIICSTSGGFPEPHLSWLENGEELSAINTTVSQDPETELYAVSSKLDFNMTTNHSFMCLIKYGHLRVNQTFNWNTTKQEHFPDN

SEQ ID NO: 968 - protein, 208 aa, synthetic construct
  REGION 1..208: note = CD80 v195 ECD
VIHVTKEVKEVATLSCGHNVSVEELAQTRIHWQKDKKMVLSMMSGDMNIWPEYKNRTIFDITNNLSILILALRPSDEGTYECVVLKYEKDAFRWEHLAEVTLSVKADFPTPSISDFETPTSNIRRIICSTSGGFPEPHLSWLENGEELSAINTTVSQDPETELYAVSSKLDFNMTTNHSFMCLIKYGHLRVNQTFNWNTTKQEHFPDN

SEQ ID NO: 969 - protein, 101 aa, synthetic construct
  REGION 1..101: note = CD80 WT IgV
VIHVTKEVKEVATLSCGHNVSVEELAQTRIYWQKEKKMVLTMMSGDMNIWPEYKNRTIFDITNNLSIVILALRPSDEGTYECVVLKYEKDAFKREHLAEVT

SEQ ID NO: 970 - protein, 101 aa, synthetic construct
  REGION 1..101: note = CD80 v122 IgV
VIHVTKEVKEVATLSCGHNVSVEELAQTRIYWQKEKKMVLTMMSGDMNIWPEYKNRTIFDITNNLSIVIPALRPSDEGTYECVVLKYEKDAFKREHLAEVT

SEQ ID NO: 971 - protein, 101 aa, synthetic construct
  REGION 1..101: note = CD80 v123 IgV
VIHVTKEVKEVATLSCGHNVSVEELAQTRFYWQKEKKMVLTMMSGDMNIWPEYKNRTIFDITNNLSIVIPALRPSDEGTYECVVLKYEKDAFKREHLAEVT

SEQ ID NO: 972 - protein, 101 aa, synthetic construct
  REGION 1..101: note = CD80 v124 IgV
VIHVTKEVKEVATLSCGHNVSVEELAHTRIYWQKEKKMVLSMMSGDMNIWPEYKNRTIFDITNNLSIVILDLRPSDEGTYECVVLKYEKDAFKREHLAEVT

SEQ ID NO: 973 - protein, 101 aa, synthetic construct
  REGION 1..101: note = CD80 v125 IgV
VIHVTKEVKEVATLSCGHNVSVEELAQTRTYWQKEKKMVLTMMSGDMNIWPEYKNRTIFDITNNLSIVIRALRPSDEGTYECVVLKYEKDAFKREHLAEVT

SEQ ID NO: 974 - protein, 101 aa, synthetic construct
  REGION 1..101: note = CD80 v126 IgV
VIHVTKEVKEVARLSRGHNVSVEELAQTRIYWQKEKKMVLTMMSGDMNIWPEYKNRTIFDITNNLSIVIQDLRPSDEGTYECVVLKYEKDAFKREHLAEVT

SEQ ID NO: 975 - protein, 101 aa, synthetic construct
  REGION 1..101: note = CD80 v127 IgV
VIHVTKEVKEVATLSCGHNVSVEELAQTRIYWQKEKKMVLTMMSGDMNIWPEYKNRIIFDITNNLSIVILALRPSDEGTYECVVLKYEKDAFKREHLAEVT

SEQ ID NO: 976 - protein, 101 aa, synthetic construct
  REGION 1..101: note = CD80 v128 IgV
VIHVTKEVKEVATLSCGHNVSVEELAQTRIYWQKEKKMVLTMISGDMNIWPEYKNRTIFDITNNLSIVILALRPSDEGTYERVVLKYEKDAFKREHLAEVT

SEQ ID NO: 977 - protein, 101 aa, synthetic construct
  REGION 1..101: note = CD80 v130 IgV
VIHVTKEVKEVATLSCGHNVSLEELAQTRIYWQKEKKVVLTMMSGDTNIWPEYKNRTIFDITNNLSIVILDLRPSDEGTYECVVMKYEKDAFKREHLAEVT

SEQ ID NO: 978 - protein, 101 aa, synthetic construct
  REGION 1..101: note = CD80 v131 IgV
VIHVTKEVKEVATLSCGHNVSVEELAQTRVYWQKEKKMVLTMMSGDMNIWPEYKNRIIFDITNNLSIVIPDLRPSDEGTYECVVLKYEKDTFKREHLAEVT

SEQ ID NO: 979 - protein, 101 aa, synthetic construct
  REGION 1..101: note = CD80 v132 IgV
VIHVTKEVKEVATLSCGHNVSIEELAQTRIYWQKEKKMVLTMMSGDMNIWPEYKNRTIFDITNNLSIVIMDLRPSDEGTYECVVLKYEKDAFKREHLAEVT

SEQ ID NO: 980 - protein, 101 aa, synthetic construct
  REGION 1..101: note = CD80 v133 IgV
VIHVTKEVKEVATLSCGHNVSVEELAQTRIYWQKEKKMVLTMMSGDMNIWPEYKDRTIFDITNNLSIVIPALRPSDGGTYECVVLKYEKDAFKREHLAEVT

SEQ ID NO: 981 - protein, 101 aa, synthetic construct
  REGION 1..101: note = CD80 v134 IgV
VIHVTKEVKEVATLSCGHNVSVEELAQTRIYWQKEKKMVLTMMSGDMNIWPEYKNRAIFDITNNLSIVTLALRPSDEGTYECVVLKYEKDAFKREHLAEVT

SEQ ID NO: 982 - protein, 101 aa, synthetic construct
  REGION 1..101: note = CD80 v135 IgV
VIHVTKEVKEVATLSCGHNVSVEELAQTRIYWQKEKKMVLTMMSGDMNIWPEYKDRTIFDITNNLSIVILALRPSDEGTYECVVLMYEKDAFKREHLAEVT

SEQ ID NO: 983 - protein, 101 aa, synthetic construct
  REGION 1..101: note = CD80 v136 IgV
VIHVTKEVKEVATLSCGHNVSVEELAQTRIYWQKEKKMVLTMMSGDMNIWPEYKNRTIFDITNNLSIVILAPRPSDEGIYECVVLKYEKDAFKREHLAEVT

SEQ ID NO: 984 - protein, 101 aa, synthetic construct
  REGION 1..101: note = CD80 v137 IgV
VIHVTKEVKEVATLSCGHNVSVEELAQTRIYWQKEKKMVLTMMSGDMNIWPEYKNRTIFDITNNLSIVIPALRPSDEGTYECVVLKYEKDASKREHLAEVT

SEQ ID NO: 985 - protein, 101 aa, synthetic construct
  REGION 1..101: note = CD80 v138 IgV
VIHVTKEVKEVATLSCGHNVSVEELAQTRIYWQKEKKMVLTMMSGDMNIWPEYKNRTIFDITNNLSIVILALRPSDEGPYECVVLKYEKDAFKREHLAEVT

SEQ ID NO: 986 - protein, 101 aa, synthetic construct
  REGION 1..101: note = CD80 v139 IgV
VIHVTKEVKEVATLSCGHNVSVEELAQTRIYWQKDKKMVLTMMSGDINIWPEYKNRTIFDITNNPSIVILALRPSDEGTYECVVLKYEKNAFKREHLAEVT

SEQ ID NO: 987 - protein, 101 aa, synthetic construct
  REGION 1..101: note = CD80 v140 IgV
VIHVTKEVKEVATLSCGHNVSVEESAQTRIYWQKDKKMVLTMMSGDINIWPEYKNRTIFDITNNLSIVILALRPSDEGTYECVVLKYEKNAFKREHLAEVT

SEQ ID NO: 988 - protein, 101 aa, synthetic construct
  REGION 1..101: note = CD80 v141 IgV
  VARIANT 27: note = Xaa = unknown
VIHVTKEVKEVATLSCGHNVSVEELAXTRIYWQKEKKMVLTMMPGDMNIWPEYKNRTIFDITNNLSTVILALRSSDEGTYGCVVLKYEKDAFKRDHLAEVT

SEQ ID NO: 989 - protein, 101 aa, synthetic construct
  REGION 1..101: note = CD80 v142 IgV
VIHVTKEVKEVATLSCGHNVSVEELAQTRIYWQKEKKMVLTMMSGDMNIWPEYKNRTIFDITNNLSIVILDLRPSDEGTYECVVLKYEKDAFKREHLAEVT

SEQ ID NO: 990 - protein, 101 aa, synthetic construct
  REGION 1..101: note = CD80 v143 IgV
  VARIANT 27: note = Xaa = unknown
VIHVTKEVKEVAALSCGHNVSVEELAXTRIYWQKEKKMVLTMMSGDMNIWPEYKNRTIFDNTNNLSIVILDLRPSDEGTYECVVLKYEKDAFKREHLAEVT

SEQ ID NO: 991 - protein, 101 aa, synthetic construct
  REGION 1..101: note = CD80 v144 IgV
VIHVTKEVKEVATLSCGHNVSVEELAQTRIYWQKEKKMVLTMMSGDMNIWPEYKNRTIFDITNNLSIVILALRPSDEGTYKCVVLKYEKDSFKREHLAEVT

SEQ ID NO: 992 - protein, 101 aa, synthetic construct
  REGION 1..101: note = CD80 v145 IgV
VIHVTKEVKEVVTLSCGHNVSVEELAQTRIYWQKEKKMVLTMMSGDVNIWPEYKNRTIFDITNNLSIVIMALRPSDEGTYECVVLKYEKDAFKREHLAEVT

SEQ ID NO: 993 - protein, 101 aa, synthetic construct
  REGION 1..101: note = CD80 v146 IgV
VIHVTKEVKEVATLSCGHNVSVEELAQTRIYWQEEKKMVLAMMSGDMNIWPEYKNRTIFDITNNLSIVILAVRPSDEGTYECVVLKYEKDAFKREHLAEVT

SEQ ID NO: 994 - protein, 101 aa, synthetic construct
  REGION 1..101: note = CD80 v147 IgV
VIHVTKEVKEVATLSCGHNVSVEELAQTRIYWQKEKKMVLSMMSGDMNIWPEYKNRTIFDITNNLSIVILDLRPSDEGTYECVALKYEKDAFKREHLAEVT

SEQ ID NO: 995 - protein, 101 aa, synthetic construct
  REGION 1..101: note = CD80 v148 IgV
VIHVTKEVKEVATLSCGHNVSVEELAQTRIYWQKDKKMVLTMMSGDMNIWPEYKNRTIFDITNNLSIVILDLRPSDEGTYECVVLKYEKDAFKREHLAEVT

SEQ ID NO: 996 - protein, 101 aa, synthetic construct
  REGION 1..101: note = CD80 v149 IgV
VIHVTKEVKEVATLSCGHNVSVEELAQTRIYWQKDKKMVLTMMSGDINIWPEYKNRTIFDITNNLSIVILALRPSDEGTYECVVLKYEKDAFKREHLAEVT

SEQ ID NO: 997 - protein, 101 aa, synthetic construct
  REGION 1..101: note = CD80 v150 IgV
VIHVTKEVKEVATLSCGHNVSVEELAQTRIYWQKERKMVLTMMSGDMNIWPEYKNRTIFDITNNLSIVILALRPSDEATYECVVLKYEKDAFKREHLAEVT

SEQ ID NO: 998 - protein, 101 aa, synthetic construct
  REGION 1..101: note = CD80 v151 IgV
VIHVTKEVKEVATLSCGHNVSVEELAQTRIYWEKEKKMVLAMMSGDMNIWPEYKNRTIFDITNNLSIVILALRPSDEGTYECVVLKYEKDAFKREHLAEVT

SEQ ID NO: 999 - protein, 101 aa, synthetic construct
  REGION 1..101: note = CD80 v152 IgV
VIHVTKEVKEVATLSCGHNVSVEELAQTRIYWQKEKKMVLTMMSGDVHIWPEYKNRTIFDITNNLSIVILALRPSDEGTYECVVLKYEKDAFKREHLAEVT

SEQ ID NO: 1000 - protein, 101 aa, synthetic construct
  REGION 1..101: note = CD80 v153 IgV
VIHVTKEVKEVATLSCGHNVSVEELAQTRIYWQKEKKMVLTMMSGDLNIWPEYKNRTIFDITNNLSIAILALRPSDEGTYECVVLKYEKDAFKREHLAEVT

SEQ ID NO: 1001 - protein, 101 aa, synthetic construct
  REGION 1..101: note = CD80 v154 IgV
VIHVTKEVKEVATLSCGHNVSVEELAQTRIYWQKEKKMVLTMMPGDMNIWPEYKNRTIFDITNNLSIVILDLRPSDEGTYECVVLKYEKDAFKREHLAEVT

SEQ ID NO: 1002 - protein, 101 aa, synthetic construct
  REGION 1..101: note = CD80 v155 IgV
VIHVTKEVKEVATLSCGHNVSVEELAHTRIYWQKEKKMVLTMISGDMNIWPEYKNRTIFDITNNLSIVILDLSPSDEGTYECVVLKYEKDAFKREHLAEVT

SEQ ID NO: 1003 - protein, 101 aa, synthetic construct
  REGION 1..101: note = CD80 v156 IgV
  VARIANT 24: note = Xaa = unknown
VIHVTKEVKEVATLSCGHNVSVEXLAQTRIYWRKEKKMVLTMMSGDMNIWPEYNNRIIFDITNNLSVVILDLRPSDEGTYECVVLKYEKDAFKREHLAEVT

SEQ ID NO: 1004 - protein, 101 aa, synthetic construct
  REGION 1..101: note = CD80 v157 IgV
VIHVTKEVKEVATLSCGHNVSVEELAQTRIYWQKDKKMVLTMMSGDMNIWPEYKNRIIFDITNNLSIVIQDLRPSDEGTYECVVLKYEKDAFKREHLAEVT

SEQ ID NO: 1005 - protein, 101 aa, synthetic construct
  REGION 1..101: note = CD80 v158 IgV
VIHVTKEVKEVATLSCGHNVSVEELAQTRIYWQKEKKMVLTMMSGDINIWPEYKNRTIFDITNNLSIVILALRPSDEGTYECVVLKYDKDAFKREHLAEVT

SEQ ID NO: 1006 - protein, 101 aa, synthetic construct
  REGION 1..101: note = CD80 v159 IgV
VIHVTKEVKEVATLSCGHNVSVEELAQTRIYWQKEKKMVLTIMSGDMNIWPEYKNRTIFDVTNNLSIVILDLRPSDEGTYECVVLKYEKDAFKREHLAEVT

SEQ ID NO: 1007 - protein, 101 aa, synthetic construct
  REGION 1..101: note = CD80 v160 IgV
VIHVTKEVKEVATLSCGHNVSVEELAQTRIYWQKEKKMVLTMMSGDMNIWAEYKNRTIFDITNNLSIVILDLRPSDEGTYECVVLKYEKDAFKREHLAEVT

SEQ ID NO: 1008 - protein, 101 aa, synthetic construct
  REGION 1..101: note = CD80 v161 IgV
VIHVTKEVKEVATLSCGYNVSVEELAQTRIYWQKEKKMVLTMMSGDINIWPEYKNRIIFDITNNLSIVILGLRPSDEGTYECVVLKYEKDAFKREHLAEVT

SEQ ID NO: 1009 - protein, 101 aa, synthetic construct
  REGION 1..101: note = CD80 v162 IgV
VIHVTKEVKEVATLSCGHNISVEELAQTRIYWQKEKKMVLTMMSGDVNIWPEYKNRIIFDITNNLSIVILALRPSDEGTYECVILKYEKDAFKREHLAEVT

SEQ ID NO: 1010 - protein, 101 aa, synthetic construct
  REGION 1..101: note = CD80 v163 IgV
VIHVTKEVKEVATLSCGHNISVEELAQTRIYWQKEKKMVLTMMSGDVNIWPEYKNRTIFDITNNLSIVILDLRPSDEGTYECVVLKYEKDAFKREHLAEVT

SEQ ID NO: 1011 - protein, 101 aa, synthetic construct
  REGION 1..101: note = CD80 v164 IgV
VIHVTKEVKEVATLSCGHNVSVEELAQTRIYWQKEKKMVLTMMSGDMNIWPEYKNRTIFDITNNLSIVILDVRPSDEGTYECVVLKYEKDAFKRKHLAEVT

SEQ ID NO: 1012 - protein, 101 aa, synthetic construct
  REGION 1..101: note = CD80 v165 IgV
VIHVTKEVKEVATLSCGHNVSLEELAQTRIYWQKGKKMVLTMMSGDMNIWPEYKNRTIFDITNNLSIVILDPRPSDEGTYECVVLKYEKDAFKREHLAEVT

SEQ ID NO: 1013 - protein, 101 aa, synthetic construct; identical to SEQ ID NO: 995
  REGION 1..101: note = CD80 v166 IgV

SEQ ID NO: 1014 - protein, 101 aa, synthetic construct
  REGION 1..101: note = CD80 v167 IgV
VIHVTKEVKEVATLSCGHNVSVEELAQTRIYWQKDKKMVLTMMSGDMNIWPEYKNRTIFDITNNLSLVILDLRPSDEGTYECVVLKYEKDAFKREHLAEVT

SEQ ID NO: 1015 - protein, 101 aa, synthetic construct
  REGION 1..101: note = CD80 v168 IgV
VIHVTKEVKEVATLSCGHNVSVEELAHTRIYWQKGKKMVLTMMSGDMNIWPEYKNRTIFDITNNLSIVILDPRPSDEGIYECVVLKYEKDAFKREHLAEVT

SEQ ID NO: 1016 - protein, 101 aa, synthetic construct
  REGION 1..101: note = CD80 v169 IgV
VIHVTKEVKEVARLSCGHNVSVEELAQTRIYWQKEKKMVLTVMSGDINIWPEYKNRTIFDITNNLSIVILDLRPSDEGTYECVVLKYEKDAFKREHLAEVT

SEQ ID NO: 1017 - protein, 101 aa, synthetic construct
  REGION 1..101: note = CD80 v170 IgV
VIHVTKEVKEVATLSCGHNVSVEELAQTRIYWQKDKKMVLTMMSGDMNIWPEYKNRTIFDITNNLSIVILALRPSDEGTYECVVLKYEKDAFKREHLAEVT

SEQ ID NO: 1018 - protein, 101 aa, synthetic construct
  REGION 1..101: note = CD80 v171 IgV
VIHVTKEVKEVATLSCGHNVSVEELAQTRIYWQKDKKMVLTMMSGDINIWPEYKNRTIFDITNNLSIVIMALRPSDEGTYECVVLKYEKDAFKREHLAEVT

SEQ ID NO: 1019 - protein, 101 aa, synthetic construct
  REGION 1..101: note = CD80 v172 IgV
VIHVTKEVKEVATLSCGHNVSVEELAQTRIYWQKDKKMVLTMMSGDMNIWPEYKNRTIFDITNNLSIVILDVRPSDEGTYECVVLKYEKDAFKREHLAEVT

SEQ ID NO: 1020 - protein, 101 aa, synthetic construct
  REGION 1..101: note = CD80 v173 IgV
VIHVTKEVKEVATLSCGHNVSVEELAQTRIYWQKDKKMVLTMLSGDMNIWPEYKNRTIFDITNNLSIVIMALRPSDEGTYECVVLKYEKDAFKREHLAEVT

SEQ ID NO: 1021 - protein, 101 aa, synthetic construct
  REGION 1..101: note = CD80 v174 IgV
VIHVTKEVKEVATLSCGHNVSVEELPQTRIYWQKDKKMVLTMISGDMNIWPEYKNRTIFDITNNLSIVILALRPSDEGTYECVVQKYDKDAFKREHLAEVT

SEQ ID NO: 1022 - protein, 101 aa, synthetic construct
  REGION 1..101: note = CD80 v175 IgV
VIHVTKEVKEVATLSCGHNVSVEELAQTRIYWQKDKKMVLTMMSGVMNIWPEYKNRTIFDITNNLSIVILALRPSDEGTYECVVQKYEKDAFKREHLAEVT

SEQ ID NO: 1023 - protein, 101 aa, synthetic construct
  REGION 1..101: note = CD80 v176 IgV
VIHVTKEVKEVATLSCGHNVSVEELALTRIYWQKDKKMVLTMMSGDINIWPEYKNRIIFDITNNLSIVIQALRPSDEGTYECVVLKYDKDAFKREHLAEVT

SEQ ID NO: 1024 - protein, 101 aa, synthetic construct
  REGION 1..101: note = CD80 v177 IgV
VIHVTKEVKEVATLSCGHNVSVEELAQTRIYWQKEKKMVLTMMSGDVNIWPEYKNRTIFDITNNLSIVFLDLRPSDEGTYECIVLKYEKDAFKREHLAEVT

SEQ ID NO: 1025 - protein, 101 aa, synthetic construct
  REGION 1..101: note = CD80 v178 IgV
VIHVTKEVKEVATLSCGHNVSVEELAQTRIYWQKDKKMVLTMMSGDMNIWPEYKNRAIFDITNNLSIVILDLRPSDEGTYECVVQKYEKDAFKREHLAEVT

SEQ ID NO: 1026 - protein, 101 aa, synthetic construct
  REGION 1..101: note = CD80 v179 IgV
VIHVTKEVKEVATLSCGYNVSVEELTQTRIYWQKDKKMVLTMMSGDMNIWPEYKNRTIFDITNNLSIVILDLRPSDEGTYECVVQKYEKDAFKREHLAEVT

SEQ ID NO: 1027 - protein, 101 aa, synthetic construct
  REGION 1..101: note = CD80 v180 IgV
VIHVTKEVKEVATLSCGHNVSVEELAQTRIYWQKDKKMVLTMMSGDLNIWPEYKNRTIFDITNNLSIVILALRPSDEGTYECVVLKYEKDAFKREHLAEVT

SEQ ID NO: 1028 - protein, 101 aa, synthetic construct
  REGION 1..101: note = CD80 v181 IgV
VIHVTKEVKEVATLSCGHNVSVDELAQTRIYWQKEKKMVLTVISGDMNIWPEYKNRTVFDITNNLSIVIRALRPSDEGTYECVVLKYEKDAFKREHLAEVT

SEQ ID NO: 1029 - protein, 101 aa, synthetic construct
  REGION 1..101: note = CD80 v182 IgV
VIHVTKEVKEVATLSCGHNVSVEELAQTRIYWQKEKKMVLTMMSGDMNIWPEYKNRTIFDITNNLSIMIMDLRPSDEGTYECVVLKYEKDAFKRKHLAEVT

SEQ ID NO: 1030 - protein, 101 aa, synthetic construct
  REGION 1..101: note = CD80 v183 IgV
VIHVTKEVKEVATLSCGHNVSVEELAQTRIYWQKEKKMVLTMMSGDMNIWPEYKIRIIFDITNNLSIVFLALRPSDEGTYECVVLKYEKDAFKREHLAEVT

SEQ ID NO: 1031 - protein, 101 aa, synthetic construct
  REGION 1..101: note = CD80 v184 IgV
VIHVTKEVKEVATLSCGHNVSVEELAQTRIYWQKDKKMVLTMISGDMNIWPEYKNRTIFDITNNLSIVILDLRPSDEGTYECVVLKYEKDAFKREHLAEVT

SEQ ID NO: 1032 - protein, 101 aa, synthetic construct
  REGION 1..101: note = CD80 v185 IgV
VIHVTKEVKEVATLSCGHNVSVEELAQTRIYWQKEKKMVLSMMSGDMNIWPEYKNRIIFDITNNLSIVIRALRPSDEGTYECVVLKYEKDAFKREHLAEVT

SEQ ID NO: 1033 - protein, 101 aa, synthetic construct
  REGION 1..101: note = CD80 v186 IgV
VIHVTKEVKEVATLSCGYNVSVEELAQTRIYWQKEKKMVLTMMSGDMNIWPEYKNRTIFDITNNLSIVILDPRPSDEGTYECVVLKYVKDAFKREHLAEVT

SEQ ID NO: 1034 - protein, 101 aa, synthetic construct
  REGION 1..101: note = CD80 v187 IgV
VIHVTKEVKEVATLSCGHNISVEELAQTRIYWQKEKKMVLTMMSGDMNIWPEYKNRTIFDITNNLSIVILDLRPSDEGTYECVVLKYEKDAFKREHLAEVT

SEQ ID NO: 1035 - protein, 101 aa, synthetic construct
  REGION 1..101: note = CD80 v188 IgV
VIHVTKEVKEVATLSCGHNVSVGELSQTRIYWQKDKKMVLTMMSGDMNIWPEYKNRTIFDINNNLSIVILDVRPSDEGTYECVVMKYEKDAFKREHLAEVT

SEQ ID NO: 1036 - protein, 101 aa, synthetic construct
  REGION 1..101: note = CD80 v189 IgV
VIHVTKEVKEVTTLSCGHNVSVEDLAQTRIYWQKDKKMVLTMMSGVMNIWPEYKNRTIFDVTNNLSIVILAPRPSDEGTYECVVLKYEKDAFKRVHLAEVT

SEQ ID NO: 1037 - protein, 101 aa, synthetic construct
  REGION 1..101: note = CD80 v190 IgV
VIHVTKEVKEVATLSCGHNVSLEELAQTRIYWQKDKKMVLTMLSGDMNIWPEYKNRTIFDITNNLSIVILGLRPSHEGTYECVVLKYEKDAFKREHLAEVT

SEQ ID NO: 1038 - protein, 101 aa, synthetic construct
  REGION 1..101: note = CD80 v191 IgV
VIHVTKEVKEVATLSCGHNVSVEELAQTRIYWQKGKKMVLTMMSGDMNIWPEYENRTIFDITNNLSIVILDPRPSDEGTYECVVLKYEKDAFKREHLAEVT

SEQ ID NO: 1039 - protein, 101 aa, synthetic construct
  REGION 1..101: note = CD80 v192 IgV
VIHVTKEVKEVATLSCGHNVSVEELAQTRIYWQKEKKMVLTMMSGDMNIWPEYKNRTIFDITNNLSIVIQDLRPSDEGTYECVVLKYEKDAFKREHLAEVT

SEQ ID NO: 1040 - protein, 101 aa, synthetic construct
  REGION 1..101: note = CD80 v193 IgV
VIHVTKEVKEVATLSCGHNVSVEELEQTRIYWQKDKKMVLTMMSGDLNIWPEYKNRTIFDITNNLSIVILALRPSDEGTYECVVQKYEKDAFKREHLAEVT

SEQ ID NO: 1041 - protein, 101 aa, synthetic construct
  REGION 1..101: note = CD80 v194 IgV
VIHVTKEVKEVATLSCGHNVSVEELAQTRIYWQKEKKMVLTMMSGEMNIWPEYKNRTIFDITNNLSIVILDLRPSDEGTYECVVLKYEKDAFKREHLAEVT

SEQ ID NO: 1042 - protein, 101 aa, synthetic construct
  REGION 1..101: note = CD80 v195 IgV
VIHVTKEVKEVATLSCGHNVSVEELAQTRIHWQKDKKMVLSMMSGDMNIWPEYKNRTIFDITNNLSILILALRPSDEGTYECVVLKYEKDAFRWEHLAEVT

SEQ ID NO: 1043 - protein, 107 aa, synthetic construct
  REGION 1..107: note = CD80 WT IgV
VIHVTKEVKEVATLSCGHNVSVEELAQTRIYWQKEKKMVLTMMSGDMNIWPEYKNRTIFDITNNLSIVIQALRPSDEGTYECVVLKYEKDGFKREHLAEVTLSVKAD

SEQ ID NO: 1044 - protein, 107 aa, synthetic construct
  REGION 1..107: note = CD80 v122 IgV
VIHVTKEVKEVATLSCGHNVSVEELAQTRIYWQKEKKMVLTMMSGDMNIWPEYKNRTIFDITNNLSIVIPALRPSDEGTYECVVLKYEKDAFKREHLAEVTLSVKAD

SEQ ID NO: 1045 - protein, 107 aa, synthetic construct
  REGION 1..107: note = CD80 v123 IgV
VIHVTKEVKEVATLSCGHNVSVEELAQTRFYWQKEKKMVLTMMSGDMNIWPEYKNRTIFDITNNLSIVIPALRPSDEGTYECVVLKYEKDAFKREHLAEVTLSVKAD

SEQ ID NO: 1046 - protein, 107 aa, synthetic construct
  REGION 1..107: note = CD80 v124 IgV
VIHVTKEVKEVATLSCGHNVSVEELAHTRIYWQKEKKMVLSMMSGDMNIWPEYKNRTIFDITNNLSIVILDLRPSDEGTYECVVLKYEKDAFKREHLAEVTLSVKAD

SEQ ID NO: 1047 - protein, 107 aa, synthetic construct
  REGION 1..107: note = CD80 v125 IgV
VIHVTKEVKEVATLSCGHNVSVEELAQTRTYWQKEKKMVLTMMSGDMNIWPEYKNRTIFDITNNLSIVIRALRPSDEGTYECVVLKYEKDAFKREHLAEVTLSVKAD

SEQ ID NO: 1048 - protein, 107 aa, synthetic construct
  REGION 1..107: note = CD80 v126 IgV
VIHVTKEVKEVARLSRGHNVSVEELAQTRIYWQKEKKMVLTMMSGDMNIWPEYKNRTIFDITNNLSIVIQDLRPSDEGTYECVVLKYEKDAFKREHLAEVTLSVKAD

SEQ ID NO: 1049 - protein, 107 aa, synthetic construct
  REGION 1..107: note = CD80 v127 IgV
VIHVTKEVKEVATLSCGHNVSVEELAQTRIYWQKEKKMVLTMMSGDMNIWPEYKNRIIFDITNNLSIVILALRPSDEGTYECVVLKYEKDAFKREHLAEVTLSVKAD

SEQ ID NO: 1050 - protein, 107 aa, synthetic construct
  REGION 1..107: note = CD80 v128 IgV
VIHVTKEVKEVATLSCGHNVSVEELAQTRIYWQKEKKMVLTMISGDMNIWPEYKNRTIFDITNNLSIVILALRPSDEGTYERVVLKYEKDAFKREHLAEVTLSVKAD

SEQ ID NO: 1051 - protein, 107 aa, synthetic construct
  REGION 1..107: note = CD80 v130 IgV
VIHVTKEVKEVATLSCGHNVSLEELAQTRIYWQKEKKVVLTMMSGDTNIWPEYKNRTIFDITNNLSIVILDLRPSDEGTYECVVMKYEKDAFKREHLAEVTLSVKAD

SEQ ID NO: 1052 - protein, 107 aa, synthetic construct
  REGION 1..107: note = CD80 v131 IgV
VIHVTKEVKEVATLSCGHNVSVEELAQTRVYWQKEKKMVLTMMSGDMNIWPEYKNRIIFDITNNLSIVIPDLRPSDEGTYECVVLKYEKDTFKREHLAEVTLSVKAD

SEQ ID NO: 1053 - protein, 107 aa, synthetic construct
  REGION 1..107: note = CD80 v132 IgV
VIHVTKEVKEVATLSCGHNVSIEELAQTRIYWQKEKKMVLTMMSGDMNIWPEYKNRTIFDITNNLSIVIMDLRPSDEGTYECVVLKYEKDAFKREHLAEVTLSVKAD

SEQ ID NO: 1054 - protein, 107 aa, synthetic construct
  REGION 1..107: note = CD80 v133 IgV
VIHVTKEVKEVATLSCGHNVSVEELAQTRIYWQKEKKMVLTMMSGDMNIWPEYKDRTIFDITNNLSIVIPALRPSDGGTYECVVLKYEKDAFKREHLAEVTLSVKAD

SEQ ID NO: 1055 - protein, 107 aa, synthetic construct
  REGION 1..107: note = CD80 v134 IgV
VIHVTKEVKEVATLSCGHNVSVEELAQTRIYWQKEKKMVLTMMSGDMNIWPEYKNRAIFDITNNLSIVTLALRPSDEGTYECVVLKYEKDAFKREHLAEVTLSVKAD

SEQ ID NO: 1056 - protein, 107 aa, synthetic construct
  REGION 1..107: note = CD80 v135 IgV
VIHVTKEVKEVATLSCGHNVSVEELAQTRIYWQKEKKMVLTMMSGDMNIWPEYKDRTIFDITNNLSIVILALRPSDEGTYECVVLMYEKDAFKREHLAEVTLSVKAD

SEQ ID NO: 1057 - protein, 107 aa, synthetic construct
  REGION 1..107: note = CD80 v136 IgV
VIHVTKEVKEVATLSCGHNVSVEELAQTRIYWQKEKKMVLTMMSGDMNIWPEYKNRTIFDITNNLSIVILAPRPSDEGIYECVVLKYEKDAFKREHLAEVTLSVKAD

SEQ ID NO: 1058 - protein, 107 aa, synthetic construct
  REGION 1..107: note = CD80 v137 IgV
VIHVTKEVKEVATLSCGHNVSVEELAQTRIYWQKEKKMVLTMMSGDMNIWPEYKNRTIFDITNNLSIVIPALRPSDEGTYECVVLKYEKDASKREHLAEVTLSVKAD

SEQ ID NO: 1059 - protein, 107 aa, synthetic construct
  REGION 1..107: note = CD80 v138 IgV
VIHVTKEVKEVATLSCGHNVSVEELAQTRIYWQKEKKMVLTMMSGDMNIWPEYKNRTIFDITNNLSIVILALRPSDEGPYECVVLKYEKDAFKREHLAEVTLSVKAD

SEQ ID NO: 1060 - protein, 107 aa, synthetic construct
  REGION 1..107: note = CD80 v139 IgV
VIHVTKEVKEVATLSCGHNVSVEELAQTRIYWQKDKKMVLTMMSGDINIWPEYKNRTIFDITNNPSIVILALRPSDEGTYECVVLKYEKNAFKREHLAEVTLSVKAD

SEQ ID NO: 1061 - protein, 107 aa, synthetic construct
  REGION 1..107: note = CD80 v140 IgV
VIHVTKEVKEVATLSCGHNVSVEESAQTRIYWQKDKKMVLTMMSGDINIWPEYKNRTIFDITNNLSIVILALRPSDEGTYECVVLKYEKNAFKREHLAEVTLSVKAD

SEQ ID NO: 1062 - protein, 107 aa, synthetic construct
  REGION 1..107: note = CD80 v141 IgV
  VARIANT 27: note = Xaa = unknown
VIHVTKEVKEVATLSCGHNVSVEELAXTRIYWQKEKKMVLTMMPGDMNIWPEYKNRTIFDITNNLSTVILALRSSDEGTYGCVVLKYEKDAFKRDHLAEVTLSVKAD

SEQ ID NO: 1063 - protein, 107 aa, synthetic construct
  REGION 1..107: note = CD80 v142 IgV
VIHVTKEVKEVATLSCGHNVSVEELAQTRIYWQKEKKMVLTMMSGDMNIWPEYKNRTIFDITNNLSIVILDLRPSDEGTYECVVLKYEKDAFKREHLAEVTLSVKAD

SEQ ID NO: 1064 - protein, 107 aa, synthetic construct
  REGION 1..107: note = CD80 v143 IgV
  VARIANT 27: note = Xaa = unknown
VIHVTKEVKEVAALSCGHNVSVEELAXTRIYWQKEKKMVLTMMSGDMNIWPEYKNRTIFDNTNNLSIVILDLRPSDEGTYECVVLKYEKDAFKREHLAEVTLSVKAD

SEQ ID NO: 1065 - protein, 107 aa, synthetic construct
  REGION 1..107: note = CD80 v144 IgV
VIHVTKEVKEVATLSCGHNVSVEELAQTRIYWQKEKKMVLTMMSGDMNIWPEYKNRTIFDITNNLSIVILALRPSDEGTYKCVVLKYEKDSFKREHLAEVTLSVKAD

SEQ ID NO: 1066 - protein, 107 aa, synthetic construct
  REGION 1..107: note = CD80 v145 IgV
VIHVTKEVKEVVTLSCGHNVSVEELAQTRIYWQKEKKMVLTMMSGDVNIWPEYKNRTIFDITNNLSIVIMALRPSDEGTYECVVLKYEKDAFKREHLAEVTLSVKAD

SEQ ID NO: 1067 - protein, 107 aa, synthetic construct
  REGION 1..107: note = CD80 v146 IgV
VIHVTKEVKEVATLSCGHNVSVEELAQTRIYWQEEKKMVLAMMSGDMNIWPEYKNRTIFDITNNLSIVILAVRPSDEGTYECVVLKYEKDAFKREHLAEVTLSVKAD

SEQ ID NO: 1068 - protein, 107 aa, synthetic construct
  REGION 1..107: note = CD80 v147 IgV
VIHVTKEVKEVATLSCGHNVSVEELAQTRIYWQKEKKMVLSMMSGDMNIWPEYKNRTIFDITNNLSIVILDLRPSDEGTYECVALKYEKDAFKREHLAEVTLSVKAD

SEQ ID NO: 1069 - protein, 107 aa, synthetic construct
  REGION 1..107: note = CD80 v148 IgV
VIHVTKEVKEVATLSCGHNVSVEELAQTRIYWQKDKKMVLTMMSGDMNIWPEYKNRTIFDITNNLSIVILDLRPSDEGTYECVVLKYEKDAFKREHLAEVTLSVKAD

SEQ ID NO: 1070 - protein, 107 aa, synthetic construct
  REGION 1..107: note = CD80 v149 IgV
VIHVTKEVKEVATLSCGHNVSVEELAQTRIYWQKDKKMVLTMMSGDINIWPEYKNRTIFDITNNLSIVILALRPSDEGTYECVVLKYEKDAFKREHLAEVTLSVKAD

SEQ ID NO: 1071 - protein, 107 aa, synthetic construct
  REGION 1..107: note = CD80 v150 IgV
VIHVTKEVKEVATLSCGHNVSVEELAQTRIYWQKERKMVLTMMSGDMNIWPEYKNRTIFDITNNLSIVILALRPSDEATYECVVLKYEKDAFKREHLAEVTLSVKAD

SEQ ID NO: 1072 - protein, 107 aa, synthetic construct
  REGION 1..107: note = CD80 v151 IgV
VIHVTKEVKEVATLSCGHNVSVEELAQTRIYWEKEKKMVLAMMSGDMNIWPEYKNRTIFDITNNLSIVILALRPSDEGTYECVVLKYEKDAFKREHLAEVTLSVKAD

SEQ ID NO: 1073 - protein, 107 aa, synthetic construct
  REGION 1..107: note = CD80 v152 IgV
VIHVTKEVKEVATLSCGHNVSVEELAQTRIYWQKEKKMVLTMMSGDVHIWPEYKNRTIFDITNNLSIVILALRPSDEGTYECVVLKYEKDAFKREHLAEVTLSVKAD

SEQ ID NO: 1074 - protein, 107 aa, synthetic construct
  REGION 1..107: note = CD80 v153 IgV
VIHVTKEVKEVATLSCGHNVSVEELAQTRIYWQKEKKMVLTMMSGDLNIWPEYKNRTIFDITNNLSIAILALRPSDEGTYECVVLKYEKDAFKREHLAEVTLSVKAD

SEQ ID NO: 1075 - protein, 107 aa, synthetic construct
  REGION 1..107: note = CD80 v154 IgV
VIHVTKEVKEVATLSCGHNVSVEELAQTRIYWQKEKKMVLTMMPGDMNIWPEYKNRTIFDITNNLSIVILDLRPSDEGTYECVVLKYEKDAFKREHLAEVTLSVKAD

SEQ ID NO: 1076 - protein, 107 aa, synthetic construct
  REGION 1..107: note = CD80 v155 IgV
VIHVTKEVKEVATLSCGHNVSVEELAHTRIYWQKEKKMVLTMISGDMNIWPEYKNRTIFDITNNLSIVILDLSPSDEGTYECVVLKYEKDAFKREHLAEVTLSVKAD

SEQ ID NO: 1077 - protein, 107 aa, synthetic construct
  REGION 1..107: note = CD80 v156 IgV
  VARIANT 24: note = Xaa = unknown
VIHVTKEVKEVATLSCGHNVSVEXLAQTRIYWRKEKKMVLTMMSGDMNIWPEYNNRIIFDITNNLSVVILDLRPSDEGTYECVVLKYEKDAFKREHLAEVTLSVKAD

SEQ ID NO: 1078 - protein, 107 aa, synthetic construct
  REGION 1..107: note = CD80 v157 IgV
VIHVTKEVKEVATLSCGHNVSVEELAQTRIYWQKDKKMVLTMMSGDMNIWPEYKNRIIFDITNNLSIVIQDLRPSDEGTYECVVLKYEKDAFKREHLAEVTLSVKAD

SEQ ID NO: 1079 - protein, 107 aa, synthetic construct
  REGION 1..107: note = CD80 v158 IgV
VIHVTKEVKEVATLSCGHNVSVEELAQTRIYWQKEKKMVLTMMSGDINIWPEYKNRTIFDITNNLSIVILALRPSDEGTYECVVLKYDKDAFKREHLAEVTLSVKAD

SEQ ID NO: 1080 - protein, 107 aa, synthetic construct
  REGION 1..107: note = CD80 v159 IgV
VIHVTKEVKEVATLSCGHNVSVEELAQTRIYWQKEKKMVLTIMSGDMNIWPEYKNRTIFDVTNNLSIVILDLRPSDEGTYECVVLKYEKDAFKREHLAEVTLSVKAD

SEQ ID NO: 1081 - protein, 107 aa, synthetic construct
  REGION 1..107: note = CD80 v160 IgV
VIHVTKEVKEVATLSCGHNVSVEELAQTRIYWQKEKKMVLTMMSGDMNIWAEYKNRTIFDITNNLSIVILDLRPSDEGTYECVVLKYEKDAFKREHLAEVTLSVKAD

SEQ ID NO: 1082 - protein, 107 aa, synthetic construct
  REGION 1..107: note = CD80 v161 IgV
VIHVTKEVKEVATLSCGYNVSVEELAQTRIYWQKEKKMVLTMMSGDINIWPEYKNRIIFDITNNLSIVILGLRPSDEGTYECVVLKYEKDAFKREHLAEVTLSVKAD

SEQ ID NO: 1083 - protein, 107 aa, synthetic construct
  REGION 1..107: note = CD80 v162 IgV
VIHVTKEVKEVATLSCGHNISVEELAQTRIYWQKEKKMVLTMMSGDVNIWPEYKNRIIFDITNNLSIVILALRPSDEGTYECVILKYEKDAFKREHLAEVTLSVKAD

SEQ ID NO: 1084 - protein, 107 aa, synthetic construct
  REGION 1..107: note = CD80 v163 IgV
VIHVTKEVKEVATLSCGHNISVEELAQTRIYWQKEKKMVLTMMSGDVNIWPEYKNRTIFDITNNLSIVILDLRPSDEGTYECVVLKYEKDAFKREHLAEVTLSVKAD

SEQ ID NO: 1085 - protein, 107 aa, synthetic construct
  REGION 1..107: note = CD80 v164 IgV
VIHVTKEVKEVATLSCGHNVSVEELAQTRIYWQKEKKMVLTMMSGDMNIWPEYKNRTIFDITNNLSIVILDVRPSDEGTYECVVLKYEKDAFKRKHLAEVTLSVKAD

SEQ ID NO: 1086 - protein, 107 aa, synthetic construct
  REGION 1..107: note = CD80 v165 IgV
VIHVTKEVKEVATLSCGHNVSLEELAQTRIYWQKGKKMVLTMMSGDMNIWPEYKNRTIFDITNNLSIVILDPRPSDEGTYECVVLKYEKDAFKREHLAEVTLSVKAD

SEQ ID NO: 1087 - protein, 107 aa, synthetic construct; identical to SEQ ID NO: 1069
  REGION 1..107: note = CD80 v166 IgV

SEQ ID NO: 1088 - protein, 107 aa, synthetic construct
  REGION 1..107: note = CD80 v167 IgV
VIHVTKEVKEVATLSCGHNVSVEELAQTRIYWQKDKKMVLTMMSGDMNIWPEYKNRTIFDITNNLSLVILDLRPSDEGTYECVVLKYEKDAFKREHLAEVTLSVKAD

SEQ ID NO: 1089 - protein, 107 aa, synthetic construct
  REGION 1..107: note = CD80 v168 IgV
VIHVTKEVKEVATLSCGHNVSVEELAHTRIYWQKGKKMVLTMMSGDMNIWPEYKNRTIFDITNNLSIVILDPRPSDEGIYECVVLKYEKDAFKREHLAEVTLSVKAD

SEQ ID NO: 1090 - protein, 107 aa, synthetic construct
  REGION 1..107: note = CD80 v169 IgV
VIHVTKEVKEVARLSCGHNVSVEELAQTRIYWQKEKKMVLTVMSGDINIWPEYKNRTIFDITNNLSIVILDLRPSDEGTYECVVLKYEKDAFKREHLAEVTLSVKAD

SEQ ID NO: 1091 - protein, 107 aa, synthetic construct
  REGION 1..107: note = CD80 v170 IgV
VIHVTKEVKEVATLSCGHNVSVEELAQTRIYWQKDKKMVLTMMSGDMNIWPEYKNRTIFDITNNLSIVILALRPSDEGTYECVVLKYEKDAFKREHLAEVTLSVKAD

SEQ ID NO: 1092 - protein, 107 aa, synthetic construct
  REGION 1..107: note = CD80 v171 IgV
VIHVTKEVKEVATLSCGHNVSVEELAQTRIYWQKDKKMVLTMMSGDINIWPEYKNRTIFDITNNLSIVIMALRPSDEGTYECVVLKYEKDAFKREHLAEVTLSVKAD

SEQ ID NO: 1093 - protein, 107 aa, synthetic construct
  REGION 1..107: note = CD80 v172 IgV
VIHVTKEVKEVATLSCGHNVSVEELAQTRIYWQKDKKMVLTMMSGDMNIWPEYKNRTIFDITNNLSIVILDVRPSDEGTYECVVLKYEKDAFKREHLAEVTLSVKAD

SEQ ID NO: 1094 - protein, 107 aa, synthetic construct
  REGION 1..107: note = CD80 v173 IgV
VIHVTKEVKEVATLSCGHNVSVEELAQTRIYWQKDKKMVLTMLSGDMNIWPEYKNRTIFDITNNLSIVIMALRPSDEGTYECVVLKYEKDAFKREHLAEVTLSVKAD

SEQ ID NO: 1095 - protein, 107 aa, synthetic construct
  REGION 1..107: note = CD80 v174 IgV
VIHVTKEVKEVATLSCGHNVSVEELPQTRIYWQKDKKMVLTMISGDMNIWPEYKNRTIFDITNNLSIVILALRPSDEGTYECVVQKYDKDAFKREHLAEVTLSVKAD

SEQ ID NO: 1096 - protein, 107 aa, synthetic construct
  REGION 1..107: note = CD80 v175 IgV
VIHVTKEVKEVATLSCGHNVSVEELAQTRIYWQKDKKMVLTMMSGVMNIWPEYKNRTIFDITNNLSIVILALRPSDEGTYECVVQKYEKDAFKREHLAEVTLSVKAD

SEQ ID NO: 1097 - protein, 107 aa, synthetic construct
  REGION 1..107: note = CD80 v176 IgV
VIHVTKEVKEVATLSCGHNVSVEELALTRIYWQKDKKMVLTMMSGDINIWPEYKNRIIFDITNNLSIVIQALRPSDEGTYECVVLKYDKDAFKREHLAEVTLSVKAD

SEQ ID NO: 1098 - protein, 107 aa, synthetic construct
  REGION 1..107: note = CD80 v177 IgV
VIHVTKEVKEVATLSCGHNVSVEELAQTRIYWQKEKKMVLTMMSGDVNIWPEYKNRTIFDITNNLSIVFLDLRPSDEGTYECIVLKYEKDAFKREHLAEVTLSVKAD

SEQ ID NO: 1099 - protein, 107 aa, synthetic construct
  REGION 1..107: note = CD80 v178 IgV
VIHVTKEVKEVATLSCGHNVSVEELAQTRIYWQKDKKMVLTMMSGDMNIWPEYKNRAIFDITNNLSIVILDLRPSDEGTYECVVQKYEKDAFKREHLAEVTLSVKAD

SEQ ID NO: 1100 - protein, 107 aa, synthetic construct
  REGION 1..107: note = CD80 v179 IgV
VIHVTKEVKEVATLSCGYNVSVEELTQTRIYWQKDKKMVLTMMSGDMNIWPEYKNRTIFDITNNLSIVILDLRPSDEGTYECVVQKYEKDAFKREHLAEVTLSVKAD

SEQ ID NO: 1101 - protein, 107 aa, synthetic construct
  REGION 1..107: note = CD80 v180 IgV
VIHVTKEVKEVATLSCGHNVSVEELAQTRIYWQKDKKMVLTMMSGDLNIWPEYKNRTIFDITNNLSIVILALRPSDEGTYECVVLKYEKDAFKREHLAEVTLSVKAD

SEQ ID NO: 1102 - protein, 107 aa, synthetic construct
  REGION 1..107: note = CD80 v181 IgV
VIHVTKEVKEVATLSCGHNVSVDELAQTRIYWQKEKKMVLTVISGDMNIWPEYKNRTVFDITNNLSIVIRALRPSDEGTYECVVLKYEKDAFKREHLAEVTLSVKAD

SEQ ID NO: 1103 - protein, 107 aa, synthetic construct
  REGION 1..107: note = CD80 v182 IgV
VIHVTKEVKEVATLSCGHNVSVEELAQTRIYWQKEKKMVLTMMSGDMNIWPEYKNRTIFDITNNLSIMIMDLRPSDEGTYECVVLKYEKDAFKRKHLAEVTLSVKAD

SEQ ID NO: 1104 - protein, 107 aa, synthetic construct
  REGION 1..107: note = CD80 v183 IgV
VIHVTKEVKEVATLSCGHNVSVEELAQTRIYWQKEKKMVLTMMSGDMNIWPEYKIRIIFDITNNLSIVFLALRPSDEGTYECVVLKYEKDAFKREHLAEVTLSVKAD

SEQ ID NO: 1105 - protein, 107 aa, synthetic construct
  REGION 1..107: note = CD80 v184 IgV
VIHVTKEVKEVATLSCGHNVSVEELAQTRIYWQKDKKMVLTMISGDMNIWPEYKNRTIFDITNNLSIVILDLRPSDEGTYECVVLKYEKDAFKREHLAEVTLSVKAD

SEQ ID NO: 1106 - protein, 107 aa, synthetic construct
  REGION 1..107: note = CD80 v185 IgV
VIHVTKEVKEVATLSCGHNVSVEELAQTRIYWQKEKKMVLSMMSGDMNIWPEYKNRIIFDITNNLSIVIRALRPSDEGTYECVVLKYEKDAFKREHLAEVTLSVKAD

SEQ ID NO: 1107 - protein, 107 aa, synthetic construct
  REGION 1..107: note = CD80 v186 IgV
VIHVTKEVKEVATLSCGYNVSVEELAQTRIYWQKEKKMVLTMMSGDMNIWPEYKNRTIFDITNNLSIVILDPRPSDEGTYECVVLKYVKDAFKREHLAEVTLSVKAD

SEQ ID NO: 1108 - protein, 107 aa, synthetic construct
  REGION 1..107: note = CD80 v187 IgV
VIHVTKEVKEVATLSCGHNISVEELAQTRIYWQKEKKMVLTMMSGDMNIWPEYKNRTIFDITNNLSIVILDLRPSDEGTYECVVLKYEKDAFKREHLAEVTLSVKAD

SEQ ID NO: 1109 - protein, 107 aa, synthetic construct
  REGION 1..107: note = CD80 v188 IgV
VIHVTKEVKEVATLSCGHNVSVGELSQTRIYWQKDKKMVLTMMSGDMNIWPEYKNRTIFDINNNLSIVILDVRPSDEGTYECVVMKYEKDAFKREHLAEVTLSVKAD

SEQ ID NO: 1110 - protein, 107 aa, synthetic construct
  REGION 1..107: note = CD80 v189 IgV
VIHVTKEVKEVTTLSCGHNVSVEDLAQTRIYWQKDKKMVLTMMSGVMNIWPEYKNRTIFDVTNNLSIVILAPRPSDEGTYECVVLKYEKDAFKRVHLAEVTLSVKAD

SEQ ID NO: 1111 - protein, 107 aa, synthetic construct
  REGION 1..107: note = CD80 v190 IgV
VIHVTKEVKEVATLSCGHNVSLEELAQTRIYWQKDKKMVLTMLSGDMNIWPEYKNRTIFDITNNLSIVILGLRPSHEGTYECVVLKYEKDAFKREHLAEVTLSVKAD

SEQ ID NO: 1112 - protein, 107 aa, synthetic construct
  REGION 1..107: note = CD80 v191 IgV
VIHVTKEVKEVATLSCGHNVSVEELAQTRIYWQKGKKMVLTMMSGDMNIWPEYENRTIFDITNNLSIVILDPRPSDEGTYECVVLKYEKDAFKREHLAEVTLSVKAD

SEQ ID NO: 1113 - protein, 107 aa, synthetic construct
  REGION 1..107: note = CD80 v192 IgV
VIHVTKEVKEVATLSCGHNVSVEELAQTRIYWQKEKKMVLTMMSGDMNIWPEYKNRTIFDITNNLSIVIQDLRPSDEGTYECVVLKYEKDAFKREHLAEVTLSVKAD

SEQ ID NO: 1114 - protein, 107 aa, synthetic construct
  REGION 1..107: note = CD80 v193 IgV
VIHVTKEVKEVATLSCGHNVSVEELEQTRIYWQKDKKMVLTMMSGDLNIWPEYKNRTIFDITNNLSIVILALRPSDEGTYECVVQKYEKDAFKREHLAEVTLSVKAD

SEQ ID NO: 1115 - protein, 107 aa, synthetic construct
  REGION 1..107: note = CD80 v194 IgV
VIHVTKEVKEVATLSCGHNVSVEELAQTRIYWQKEKKMVLTMMSGEMNIWPEYKNRTIFDITNNLSIVILDLRPSDEGTYECVVLKYEKDAFKREHLAEVTLSVKAD

SEQ ID NO: 1116 - protein, 107 aa, synthetic construct
  REGION 1..107: note = CD80 v195 IgV
VIHVTKEVKEVATLSCGHNVSVEELAQTRIHWQKDKKMVLSMMSGDMNIWPEYKNRTIFDITNNLSILILALRPSDEGTYECVVLKYEKDAFRWEHLAEVTLSVKAD

SEQ ID NO: 1117 - protein, 232 aa, synthetic construct
  REGION 1..232: note = Knob Fc
EPKSSDKTHTCPPCPAPEAEGAPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPCREEMTKNQVSLWCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1118 - protein, 232 aa, synthetic construct
  REGION 1..232: note = Hole Fc
EPKSSDKTHTCPPCPAPEAEGAPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVCTLPPSREEMTKNQVSLSCAVKGFYPSDIAVEWESNGQPENNYKTTPPVLDSDGSFFLVSKLTVDKSRWQQGNVFSCSVMHEALHNHYTQKSLSLSPGK

SEQ ID NO: 1119 - protein, 232 aa, synthetic construct
  REGION 1..232: note = Stack Fc (homodimeric)
EPKSSDKTHTCPPCPAPEAEGAPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1120 - protein, 8 aa, synthetic construct
  REGION 1..8: note = Stuffer
HMSSVSAQ

SEQ ID NO: 1121 - protein, 481 aa, synthetic construct
  REGION 1..481: note = PD-L2/CD155 Stack 1 Fc fusion
WPPPGTGDVVVQAPTQVSGFLGDSVTLPCYLQVPNMEVTHVSQLTWARHGESGSMAVFHQTQGPWYAESKRLEFVAARLGAELRNASLRMFGLRVEDEGNYTCQFVTFPQRSRSVDIWLRVLGGGGSGGGGSEPKSSDKTHTCPPCPAPEAEGAPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGGSGGGGSLFTVTVPKELYIIEQGSNVTLECNFDTGSHVNLGAITASLQKVENDASPHRERATLLEEQLPLGRALFHIPQVQVRDEGQYRCIIIYGDAWDYKYLTLKVKA

SEQ ID NO: 1122 - protein, 481 aa, synthetic construct
  REGION 1..481: note = PD-L2/CD155 Stack 2 Fc fusion
LFTVTVPKELYIIEQGSNVTLECNFDTGSHVNLGAITASLQKVENDASPHRERATLLEEQLPLGRALFHIPQVQVRDEGQYRCIIIYGDAWDYKYLTLKVKAGGGGSGGGGSEPKSSDKTHTCPPCPAPEAEGAPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGGSGGGGSWPPPGTGDVVVQAPTQVSGFLGDSVTLPCYLQVPNMEVTHVSQLTWARHGESGSMAVFHQTQGPWYAESKRLEFVAARLGAELRNASLRMFGLRVEDEGNYTCQFVTFPQRSRSVDIWLRVL

SEQ ID NO: 1123 - protein, 481 aa, synthetic construct
  REGION 1..481: note = PD-L2/CD155 Stack 3 Fc fusion
WPPPGTGDVVVQAPTQVSGFLGDSVTLPCYLQVPNMEVTHVSQLTWARHGESGSMAVFHQTQGPWYAESKRLEFVAARLGAELRNASLRMFGLRVEDEGNYTCQFVTFPQRSRSVDIWLRVLGGGGSGGGGSGGGGSLFTVTVPKELYIIEQGSNVTLECNFDTGSHVNLGAITASLQKVENDASPHRERATLLEEQLPLGRALFHIPQVQVRDEGQYRCIIIYGDAWDYKYLTLKVKAGGGGSGGGGSEPKSSDKTHTCPPCPAPEAEGAPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1124 - protein, 481 aa, synthetic construct
  REGION 1..481: note = PD-L2/CD155 Stack 4 Fc fusion
LFTVTVPKELYIIEQGSNVTLECNFDTGSHVNLGAITASLQKVENDASPHRERATLLEEQLPLGRALFHIPQVQVRDEGQYRCIIIYGDAWDYKYLTLKVKAGGGGSGGGGSGGGGSWPPPGTGDVVVQAPTQVSGFLGDSVTLPCYLQVPNMEVTHVSQLTWARHGESGSMAVFHQTQGPWYAESKRLEFVAARLGAELRNASLRMFGLRVEDEGNYTCQFVTFPQRSRSVDIWLRVLGGGGSGGGGSEPKSSDKTHTCPPCPAPEAEGAPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1125 - protein, 486 aa, synthetic construct
  REGION 1..486: note = PD-L2/CD155 Stack 5 Fc fusion
EPKSSDKTHTCPPCPAPEAEGAPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGGSGGGGSWPPPGTGDVVVQAPTQVSGFLGDSVTLPCYLQVPNMEVTHVSQLTWARHGESGSMAVFHQTQGPWYAESKRLEFVAARLGAELRNASLRMFGLRVEDEGNYTCQFVTFPQRSRSVDIWLRVLGGGGSGGGGSGGGGSLFTVTVPKELYIIEQGSNVTLECNFDTGSHVNLGAITASLQKVENDASPHRERATLLEEQLPLGRALFHIPQVQVRDEGQYRCIIIYGDAWDYKYLTLKVKA

SEQ ID NO: 1126 - protein, 486 aa, synthetic construct
  REGION 1..486: note = PD-L2/CD155 Stack 6 Fc fusion
EPKSSDKTHTCPPCPAPEAEGAPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGGSGGGGSLFTVTVPKELYIIEQGSNVTLECNFDTGSHVNLGAITASLQKVENDASPHRERATLLEEQLPLGRALFHIPQVQVRDEGQYRCIIIYGDAWDYKYLTLKVKAGGGGSGGGGSGGGGSWPPPGTGDVVVQAPTQVSGFLGDSVTLPCYLQVPNMEVTHVSQLTWARHGESGSMAVFHQTQGPWYAESKRLEFVAARLGAELRNASLRMFGLRVEDEGNYTCQFVTFPQRSRSVDIWLRVL

SEQ ID NO: 1127 - protein, 481 aa, synthetic construct
  REGION 1..481: note = PD-L2/CD155 Stack 7
WPPPGTGDVVVQAPTQVSGFLGDSVTLPCYLQVPNMEVTHVSQLTWARHGESGSMAVFHQTQGPWYAESKRLEFVAARLGAELRNASLRMFGLRVEDEGNYTCQFVTFPQRSRSVDIWLRVLGGGGSGGGGSEPKSSDKTHTCPPCPAPEAEGAPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPCREEMTKNQVSLWCLVKGFYPSDIAVEWESNGQPENNYKTTPPVLDSDGSFFLYSKLTVDKSRWQQGNVFSCSVMHEALHNHYTQKSLSLSPGKGGGGSGGGGSGGGGSLFTVTVPKELYIIEQGSNVTLECNFDTGSHVNLGAITASLQKVENDASPHRERATLLEEQLPLGRALFHIPQVQVRDEGQYRCIIIYGDAWDYKYLTLKVKA

SEQ ID NO: 1128 - protein, 481 aa, synthetic construct
  REGION 1..481: note = PD-L2/CD155 Stack 8
LFTVTVPKELYIIEQGSNVTLECNFDTGSHVNLGAITASLQKVENDASPHRERATLLEEQLPLGRALFHIPQVQVRDEGQYRCIIIYGDAWDYKYLTLKVKAGGGGSGGGGSEPKSSDKTHTCPPCPAPEAEGAPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPCREEMTKNQVSLWCLVKGFYPSDIAVEWESNGQPENNYKTTPPVLDSDGSFFLYSKLTVDKSRWQQGNVFSCSVMHEALHNHYTQKSLSLSPGKGGGGSGGGGSGGGGSWPPPGTGDVVVQAPTQVSGFLGDSVTLPCYLQVPNMEVTHVSQLTWARHGESGSMAVFHQTQGPWYAESKRLEFVAARLGAELRNASLRMFGLRVEDEGNYTCQFVTFPQRSRSVDIWLRVL

SEQ ID NO: 1129 - protein, 735 aa, synthetic construct
  REGION 1..735: note = PD-L2/CD155 Stack 9
WPPPGTGDVVVQAPTQVSGFLGDSVTLPCYLQVPNMEVTHVSQLTWARHGESGSMAVFHQTQGPWYAESKRLEFVAARLGAELRNASLRMFGLRVEDEGNYTCQFVTFPQRSRSVDIWLRVLGGGGSGGGGSGGGGSWPPPGTGDVVVQAPTQVSGFLGDSVTLPCYLQVPNMEVTHVSQLTWARHGESGSMAVFHQTQGPWYAESKRLEFVAARLGAELRNASLRMFGLRVEDEGNYTCQFVTFPQRSRSVDIWLRVLGGGGSGGGGSEPKSSDKTHTCPPCPAPEAEGAPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPCREEMTKNQVSLWCLVKGFYPSDIAVEWESNGQPENNYKTTPPVLDSDGSFFLYSKLTVDKSRWQQGNVFSCSVMHEALHNHYTQKSLSLSPGKGGGGSGGGGSGGGGSLFTVTVPKELYIIEQGSNVTLECNFDTGSHVNLGAITASLQKVENDASPHRERATLLEEQLPLGRALFHIPQVQVRDEGQYRCIIIYGDAWDYKYLTLKVKAGGGGSGGGGSGGGGSLFTVTVPKELYIIEQGSNVTLECNFDTGSHVNLGAITASLQKVENDASPHRERATLLEEQLPLGRALFHIPQVQVRDEGQYRCIIIYGDAWDYKYLTLKVKA

SEQ ID NO: 1130 - protein, 735 aa, synthetic construct
  REGION 1..735: note = PD-L2/CD155 Stack 10
LFTVTVPKELYIIEQGSNVTLECNFDTGSHVNLGAITASLQKVENDASPHRERATLLEEQLPLGRALFHIPQVQVRDEGQYRCIIIYGDAWDYKYLTLKVKAGGGGSGGGGSGGGGSLFTVTVPKELYIIEQGSNVTLECNFDTGSHVNLGAITASLQKVENDASPHRERATLLEEQLPLGRALFHIPQVQVRDEGQYRCIIIYGDAWDYKYLTLKVKAGGGGSGGGGSEPKSSDKTHTCPPCPAPEAEGAPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPCREEMTKNQVSLWCLVKGFYPSDIAVEWESNGQPENNYKTTPPVLDSDGSFFLYSKLTVDKSRWQQGNVFSCSVMHEALHNHYTQKSLSLSPGKGGGGSGGGGSGGGGSWPPPGTGDVVVQAPTQVSGFLGDSVTLPCYLQVPNMEVTHVSQLTWARHGESGSMAVFHQTQGPWYAESKRLEFVAARLGAELRNASLRMFGLRVEDEGNYTCQFVTFPQRSRSVDIWLRVLGGGGSGGGGSGGGGSWPPPGTGDVVVQAPTQVSGFLGDSVTLPCYLQVPNMEVTHVSQLTWARHGESGSMAVFHQTQGPWYAESKRLEFVAARLGAELRNASLRMFGLRVEDEGNYTCQFVTFPQRSRSVDIWLRVL

SEQ ID NO: 1131 - protein, 501 aa, synthetic construct
  REGION 1..501: note = PD-L2/CD155 Stack 11 Knob Fc
WPPPGTGDVVVQAPTQVSGFLGDSVTLPCYLQVPNMEVTHVSQLTWARHGESGSMAVFHQTQGPWYAESKRLEFVAARLGAELRNASLRMFGLRVEDEGNYTCQFVTFPQRSRSVDIWLRVLGGGGSGGGGSGGGGSWPPPGTGDVVVQAPTQVSGFLGDSVTLPCYLQVPNMEVTHVSQLTWARHGESGSMAVFHQTQGPWYAESKRLEFVAARLGAELRNASLRMFGLRVEDEGNYTCQFVTFPQRSRSVDIWLRVLGGGGSGGGGSEPKSSDKTHTCPPCPAPEAEGAPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPCREEMTKNQVSLWCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1132 - protein, 461 aa, synthetic construct
  REGION 1..461: note = PD-L2/CD155 Stack 11 Hole Fc
LFTVTVPKELYIIEQGSNVTLECNFDTGSHVNLGAITASLQKVENDASPHRERATLLEEQLPLGRALFHIPQVQVRDEGQYRCIIIYGDAWDYKYLTLKVKAGGGGSGGGGSGGGGSLFTVTVPKELYIIEQGSNVTLECNFDTGSHVNLGAITASLQKVENDASPHRERATLLEEQLPLGRALFHIPQVQVRDEGQYRCIIIYGDAWDYKYLTLKVKAGGGGSGGGGSEPKSSDKTHTCPPCPAPEAEGAPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVCTLPPSREEMTKNQVSLSCAVKGFYPSDIAVEWESNGQPENNYKTTPPVLDSDGSFFLVSKLTVDKSRWQQGNVFSCSVMHEALHNHYTQKSLSLSPGK

SEQ ID NO: 1133 - protein, 514 aa, synthetic construct
  REGION 1..514: note = PD-L2/CD155 Stack 12 Knob Fc
HMSSVSAQEPKSSDKTHTCPPCPAPEAEGAPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPCREEMTKNQVSLWCLVKGFYPSDIAVEWESNGQPENNYKTTPPVLDSDGSFFLYSKLTVDKSRWQQGNVFSCSVMHEALHNHYTQKSLSLSPGKGGGGSGGGGSGGGGSWPPPGTGDVVVQAPTQVSGFLGDSVTLPCYLQVPNMEVTHVSQLTWARHGESGSMAVFHQTQGPWYAESKRLEFVAARLGAELRNASLRMFGLRVEDEGNYTCQFVTFPQRSRSVDIWLRVLGGGGSGGGGSGGGGSWPPPGTGDVVVQAPTQVSGFLGDSVTLPCYLQVPNMEVTHVSQLTWARHGESGSMAVFHQTQGPWYAESKRLEFVAARLGAELRNASLRMFGLRVEDEGNYTCQFVTFPQRSRSVDIWLRVL

SEQ ID NO: 1134 - protein, 474 aa, synthetic construct
  REGION 1..474: note = PD-L2/CD155 Stack 12 Hole Fc
HMSSVSAQEPKSSDKTHTCPPCPAPEAEGAPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVCTLPPSREEMTKNQVSLSCAVKGFYPSDIAVEWESNGQPENNYKTTPPVLDSDGSFFLVSKLTVDKSRWQQGNVFSCSVMHEALHNHYTQKSLSLSPGKGGGGSGGGGSGGGGSLFTVTVPKELYIIEQGSNVTLECNFDTGSHVNLGAITASLQKVENDASPHRERATLLEEQLPLGRALFHIPQVQVRDEGQYRCIIIYGDAWDYKYLTLKVKAGGGGSGGGGSGGGGSLFTVTVPKELYIIEQGSNVTLECNFDTGSHVNLGAITASLQKVENDASPHRERATLLEEQLPLGRALFHIPQVQVRDEGQYRCIIIYGDAWDYKYLTLKVKA

SEQ ID NO: 1135 - protein, 232 aa, synthetic construct
  REGION 1..232: note = Fc (C5S (C220S), R77C, (R292C),N82G (N297G), V87C (V302C))
EPKSSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1136 - protein, 232 aa, synthetic construct
  REGION 1..232: note = Fc with C220S/L234A/L235E/G237A
EPKSSDKTHTCPPCPAPEAEGAPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1137 - protein, 231 aa, synthetic construct
  REGION 1..231: note = Fc with C220S/E233P/L234V/L235A/G236del/S267K
EPKSSDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1138 - protein, 431 aa, synthetic construct
  REGION 1..431: note = antiCD19z chimeric antigen receptor
DIQMTQTTSSLSASLGDRVTISCRASQDISKYLNWYQQKPDGTVKLLIYHTSRLHSGVPSRFSGSGSGTDYSLTISNLEQEDIATYFCQQGNTLPYTFGGGTKLEITGSTSGSGKPGSGEGSTKGEVKLQESGPGLVAPSQSLSVTCTVSGVSLPDYGVSWIRQPPRKGLEWLGVIWGSETTYYNSALKSRLTIIKDNSKSQVFLKMNSLQTDDTAIYYCAKHYYYGGSYAMDYWGQGTSVTVSSAAAKPTTTPAPRPPTPAPTIASQPLSLRPEASRPAAGGAVHTRGLDFASDIYIWAPLAGTCGVLLLSLVITLYCRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 1139 - protein, 21 aa, synthetic construct
  REGION 1..21: note = CD8-derived signal sequence
MALPVTALLLPLALLLHAARP

SEQ ID NO: 1140 - protein, 23 aa, synthetic construct
  REGION 1..23: note = CD8-derived signal sequence
MALPVTALLLPLALLLHAARPGS

SEQ ID NO: 1141 - protein, 245 aa, synthetic construct
  REGION 1..245: note = anti-CD19 scFv
DIQMTQTTSSLSASLGDRVTISCRASQDISKYLNWYQQKPDGTVKLLIYHTSRLHSGVPSRFSGSGSGTDYSLTISNLEQEDIATYFCQQGNTLPYTFGGGTKLEITGSTSGSGKPGSGEGSTKGEVKLQESGPGLVAPSQSLSVTCTVSGVSLPDYGVSWIRQPPRKGLEWLGVIWGSETTYYNSALKSRLTIIKDNSKSQVFLKMNSLQTDDTAIYYCAKHYYYGGSYAMDYWGQGTSVTVSS

SEQ ID NO: 1142 - protein, 69 aa, synthetic construct
  REGION 1..69: note = CD8-derived hinge and transmembrane domain
AKPTTTPAPRPPTPAPTIASQPLSLRPEACRPAAGGAVHTRGLDFACDIYIWAPLAGTCGVLLLSLVIT

SEQ ID NO: 1143 - protein, 42 aa, synthetic construct
  REGION 1..42: note = 4-1BB-derived costimulatory domain
KRGRKKLLYIFKQPFMRPVQTTQEEDGCSCRFPEEEEGGCEL

SEQ ID NO: 1144 - protein, 40 aa, synthetic construct
  REGION 1..40: note = CD28-derived costimulatory domain
SKRSRLLHSDYMNMTPRRPGPTRKHYQPYAPPRDFAAYRS

SEQ ID NO: 1145 - protein, 41 aa, synthetic construct
  REGION 1..41: note = CD28-derived costimulatory domain
RSKRSRLLHSDYMNMTPRRPGPTRKHYQPYAPPRDFAAYRS

SEQ ID NO: 1146 - protein, 44 aa, synthetic construct
  REGION 1..44: note = CD28-derived costimulatory domain
FWVRSKRSRLLHSDYMNMTPRRPGPTRKHYQPYAPPRDFAAYRS

SEQ ID NO: 1147 - protein, 20 aa, synthetic construct
  REGION 1..20: note = T2A protein
SGEGRGSLLTCGDVEENPGP

SEQ ID NO: 1148 - protein, 232 aa, synthetic construct
  REGION 1..232: note = Blue fluorescent protein
SELIKENMHMKLYMEGTVDNHHFKCTSEGEGKPYEGTQTMRIKVVEGGPLPFAFDILATSFLYGSKTFINHTQGIPDFFKQSFPEGFTWERVTTYEDGGVLTATQDTSLQDGCLIYNVKIRGVNFTSNGPVMQKKTLGWEAFTETLYPADGGLEGRNDMALKLVGGSHLIANIKTTYRSKKPAKNLKMPGVYYVDYRLERIKEANNETYVEQHEVAVARYCDLPSKLGHKLN

SEQ ID NO: 1149 - protein, 472 aa, synthetic construct
  REGION 1..472: note = 2nd Gen CAR
DIQMTQTTSSLSASLGDRVTISCRASQDISKYLNWYQQKPDGTVKLLIYHTSRLHSGVPSRFSGSGSGTDYSLTISNLEQEDIATYFCQQGNTLPYTFGGGTKLEITGSTSGSGKPGSGEGSTKGEVKLQESGPGLVAPSQSLSVTCTVSGVSLPDYGVSWIRQPPRKGLEWLGVIWGSETTYYNSALKSRLTIIKDNSKSQVFLKMNSLQTDDTAIYYCAKHYYYGGSYAMDYWGQGTSVTVSSASAKPTTTPAPRPPTPAPTIASQPLSLRPEACRPAAGGAVHTRGLDFACDIYIWAPLAGTCGVLLLSLVITMHKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 1150 - protein, 497 aa, synthetic construct
  REGION 1..497: note = 2nd Gen CAR
DIQMTQTTSSLSASLGDRVTISCRASQDISKYLNWYQQKPDGTVKLLIYHTSRLHSGVPSRFSGSGSGTDYSLTISNLEQEDIATYFCQQGNTLPYTFGGGTKLEITGSTSGSGKPGSGEGSTKGEVKLQESGPGLVAPSQSLSVTCTVSGVSLPDYGVSWIRQPPRKGLEWLGVIWGSETTYYNSALKSRLTIIKDNSKSQVFLKMNSLQTDDTAIYYCAKHYYYGGSYAMDYWGQGTSVTVSSASAKPTTTPAPRPPTPAPTIASQPLSLRPEACRPAAGGAVHTRGLDFACDIYIWAPLAGTCGVLLLSLVITMHKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRGGRSGEGRGSLLTCGDVEENPGPSR

SEQ ID NO: 1151 - protein, 471 aa, synthetic construct
  REGION 1..471: note = 2nd Gen CAR with CD28-derived costimulatory domain
DIQMTQTTSSLSASLGDRVTISCRASQDISKYLNWYQQKPDGTVKLLIYHTSRLHSGVPSRFSGSGSGTDYSLTISNLEQEDIATYFCQQGNTLPYTFGGGTKLEITGSTSGSGKPGSGEGSTKGEVKLQESGPGLVAPSQSLSVTCTVSGVSLPDYGVSWIRQPPRKGLEWLGVIWGSETTYYNSALKSRLTIIKDNSKSQVFLKMNSLQTDDTAIYYCAKHYYYGGSYAMDYWGQGTSVTVSSASAKPTTTPAPRPPTPAPTIASQPLSLRPEACRPAAGGAVHTRGLDFACDIYIWAPLAGTCGVLLLSLVITMHRSKRSRLLHSDYMNMTPRRPGPTRKHYQPYAPPRDFAAYRSRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 1152 - protein, 248 aa, synthetic construct
  REGION 1..248: note = Anti-CD19 scFv
DIQMTQTTSSLSASLGDRVTISCRASQDISKYLNWYQQKPDGTVKLLIYHTSRLHSGVPSRFSGSGSGTDYSLTISNLEQEDIATYFCQQGNTLPYTFGGGTKLEITGSTSGSGKPGSGEGSTKGEVKLQESGPGLVAPSQSLSVTCTVSGVSLPDYGVSWIRQPPRKGLEWLGVIWGSETTYYNSALKSRLTIIKDNSKSQVFLKMNSLQTDDTAIYYCAKHYYYGGSYAMDYWGQGTSVTVSSAAA

SEQ ID NO: 1153 - DNA, 1356 bp, synthetic construct
  misc_feature 1..1356: note = AntiCD19 chimeric antigen receptor
  source 1..1356: mol_type = other DNA
atggccttaccagtgaccgccttgctcctgccgctggccttgctgctccacgccgccaggccggacatccagatgacacagactacatcctccctgtctgcctctctgggagacagagtcaccatcagttgcagggcaagtcaggacattagtaaatatttaaattggtatcagcagaaaccagatggaactgttaaactcctgatctaccatacatcaagattacactcaggagtcccatcaaggttcagtggcagtgggtctggaacagattattctctcaccattagcaacctggagcaagaagatattgccacttacttttgccaacagggtaatacgcttccgtacacgttcggaggggggactaagttggaaataacaggctccacctctggatccggcaagcccggatctggcgagggatccaccaagggcgaggtgaaactgcaggagtcaggacctggcctggtggcgccctcacagagcctgtccgtcacatgcactgtctcaggggtctcattacccgactatggtgtaagctggattcgccagcctccacgaaagggtctggagtggctgggagtaatatggggtagtgaaaccacatactataattcagctctcaaatccagactgaccatcatcaaggacaactccaagagccaagttttcttaaaaatgaacagtctgcaaactgatgacacagccatttactactgtgccaaacattattactacggtggtagctatgctatggactactggggtcaaggaacctcagtcaccgtctcctcagcggccgcaaagcccaccacgacgccagcgccgcgaccaccaacaccggcgcccaccatcgcgtcgcagcccctgtccctgcgcccagaggcgagccggccagcggcggggggcgcagtgcacacgagggggctggacttcgccagtgatatctacatctgggcgcccctggccgggacttgtggggtccttctcctgtcactggttatcaccctttactgcagagtgaagttcagcaggagcgcagacgcccccgcgtaccagcagggccagaaccagctctataacgagctcaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgc

SEQ ID NO: 1154 - DNA, 63 bp, synthetic construct
  misc_feature 1..63: note = T2ANucleotide
  source 1..63: mol_type = other DNA
ggcagtggcgagggcagaggaagtctgctaacatgcggtgacgtcgaggagaatcctggccca

SEQ ID NO: 1155 - protein, 21 aa, synthetic construct
  REGION 1..21: note = T2AProtein
GSGEGRGSLLTCGDVEENPGP

SEQ ID NO: 1156 - protein, 117 aa, synthetic construct
  REGION 1..117: note = NKp30 v1 ECD
LWVSQPPEIRTLEGSSAFLPCSFNASQGRVAIGSVTWFRDEVVPGKEVRNGTPEFRGRLVPLAPSRFLHDHQAELHIRDVRGHDAGIYVCRVEVLGLGVGTGNGTRLVVEKEHPQLG

SEQ ID NO: 1157 - protein, 117 aa, synthetic construct
  REGION 1..117: note = NKp30 v2 ECD
LWVSQPPEIRTLEGSSAFLPCSFNASQGRVAIGSVTWFRDEVVPGKEVRNGTPEFRGRLAPLASSRFLHDHQAELHIRDVRGHDASIYVCRVEVLGLGVGTGNGTRLVVEKEHPQLG

SEQ ID NO: 1158 - protein, 117 aa, synthetic construct
  REGION 1..117: note = NKp30 v3 ECD
LWVSQPPEIRTLEGSSAFLPCSFNASQGRLAIGSVTWFRDEVVPGKEVRNGTPEFRGRLVPLASSRFLHDHQAELHIRDVRGHDASIYVCRVEVLGLGVGTGNGTRLVVEKEHPQLG

SEQ ID NO: 1159 - protein, 117 aa, synthetic construct
  REGION 1..117: note = NKp30 v4 ECD
LWVSQPPEIRTLEGSSAFLPCSFNASQGRLAIGSVTWFRDEVVPGKEVRNGTPEFRGRLAPLAPSRFLHDHQAELHIRDVRGHDASIYVCRVEVLGLGVGTGNGTRLVVEKEHPQLG

SEQ ID NO: 1160 - protein, 117 aa, synthetic construct
  REGION 1..117: note = NKp30 v5 ECD
LWVSQPPEIRTLEGSSAFLPCSFNASQGRLAIGSVTWFRDEVVPGKEVRNGTPEFRGRLAPLASSRFLHDHQAELHIRDVRGHDAGIYVCRVEVLGLGVGTGNGTRLVVEKEHPQLG

SEQ ID NO: 1161 - protein, 108 aa, synthetic construct
  REGION 1..108: note = NKp30 WT IgC-like
LWVSQPPEIRTLEGSSAFLPCSFNASQGRLAIGSVTWFRDEVVPGKEVRNGTPEFRGRLAPLASSRFLHDHQAELHIRDVRGHDASIYVCRVEVLGLGVGTGNGTRLV

SEQ ID NO: 1162 - protein, 108 aa, synthetic construct
  REGION 1..108: note = NKp30 v1 IgC-like
LWVSQPPEIRTLEGSSAFLPCSFNASQGRVAIGSVTWFRDEVVPGKEVRNGTPEFRGRLVPLAPSRFLHDHQAELHIRDVRGHDAGIYVCRVEVLGLGVGTGNGTRLV

SEQ ID NO: 1163 - protein, 108 aa, synthetic construct
  REGION 1..108: note = NKp30 v2 IgC-like
LWVSQPPEIRTLEGSSAFLPCSFNASQGRVAIGSVTWFRDEVVPGKEVRNGTPEFRGRLAPLASSRFLHDHQAELHIRDVRGHDASIYVCRVEVLGLGVGTGNGTRLV

SEQ ID NO: 1164 - protein, 108 aa, synthetic construct
  REGION 1..108: note = NKp30 v3 IgC-like
LWVSQPPEIRTLEGSSAFLPCSFNASQGRLAIGSVTWFRDEVVPGKEVRNGTPEFRGRLVPLASSRFLHDHQAELHIRDVRGHDASIYVCRVEVLGLGVGTGNGTRLV

SEQ ID NO: 1165 - protein, 108 aa, synthetic construct
  REGION 1..108: note = NKp30 v4 IgC-like
LWVSQPPEIRTLEGSSAFLPCSFNASQGRLAIGSVTWFRDEVVPGKEVRNGTPEFRGRLAPLAPSRFLHDHQAELHIRDVRGHDASIYVCRVEVLGLGVGTGNGTRLV

SEQ ID NO: 1166 - protein, 108 aa, synthetic construct
  REGION 1..108: note = NKp30 v5 IgC-like
LWVSQPPEIRTLEGSSAFLPCSFNASQGRLAIGSVTWFRDEVVPGKEVRNGTPEFRGRLAPLASSRFLHDHQAELHIRDVRGHDAGIYVCRVEVLGLGVGTGNGTRLV

SEQ ID NO: 1167 - protein, 270 aa, synthetic construct
  REGION 1..270: note = Nkp30 stack
DTQEKEVRAMVGSDVELSCACPEGSRFDLNDVYVYWQTSESKTVVTYHIPQHSSLEYVDSRYRNRALMSPAGMLRGDFSLRLFNVTPQDEQKFHCLVLSPSLGFQEVLSVEVTLHVAANFSVGGGGSGGGGSGGGGSLWVSQPPEIRTLEGSSAFLPCSFNASQGRVAIGSVTWFRDEVVPGKEVRNGTPEFRGRLVPLAPSRFLHDHQAELHIRDVRGHDAGIYVCRVEVLGLGVGTGNGTRLVVEKEHPQLGGGGGSGGGGSAAAEPK

SEQ ID NO: 1168 - protein, 116 aa, synthetic construct
  REGION 1..116: note = NKp30 v1 IgC-like (long)
LWVSQPPEIRTLEGSSAFLPCSFNASQGRVAIGSVTWFRDEVVPGKEVRNGTPEFRGRLVPLAPSRFLHDHQAELHIRDVRGHDAGIYVCRVEVLGLGVGTGNGTRLVVEKEHPQL

SEQ ID NO: 1169 - protein, 224 aa, synthetic construct
  REGION 1..224: note = CD86 v1 ECD
APLKIQAYFNETADLPCQFANSQNQSLSELVVFWHDQENLVLNEVYLGKEKFDSVHSKYMGRTSFDSDSWTLRLHNLQIKDKGLYQCIILHKKPTGMIRIHHMNSELSVLANFSQPEIVPISNITENVYINLTCSSIHGYPEPKKMSVLLRTKNSTIEYDGVMQKSQDNVTELYDVSISLSVSFPDVTSNMTIFCILETDKTRLLSSPFSIELEDPQPPPDHIP

SEQ ID NO: 1170 - protein, 224 aa, synthetic construct
  REGION 1..224: note = CD86 v2 ECD
APLKIQAYFNETADLPCQFANSQNQSLSELVVFWHDQENLVLNEVYLGKEKFDSVHSKYMGRTSFDSDSWTLRLHNLQIKDKGLYQCIIHHKKPTGMIRIHQMNSELSVLANFSQPEIVPISNITENVYINLTCSSIHGYPEPKKMSVLLRTKNSTIEYDGVMQKSQDNVTELYDVSISLSVSFPDVTSNMTIFCILETDKTRLLSSPFSIELEDPQPPPDHIP

SEQ ID NO: 1171 - protein, 224 aa, synthetic construct
  REGION 1..224: note = CD86 v3 ECD
APLKIQAYFNETADLPCQFANSQNQSLSELVVFWQDQENLVLNEVYLGKEKFDSVHSKYMGRTSFDSDSWTLRLHNLQIKDKGLYQCIILHKKPTGMIRIHQMNSELSVLANFSQPEIVPISNITENVYINLTCSSIHGYPEPKKMSVLLRTKNSTIEYDGVMQKSQDNVTELYDVSISLSVSFPDVTSNMTIFCILETDKTRLLSSPFSIELEDPQPPPDHIP

SEQ ID NO: 1172 - protein, 224 aa, synthetic construct
  REGION 1..224: note = CD86 v4 ECD
APLKIQAYFNETADLPCQFANSQNQSLSELVVFWQDQENLVLNEVYLGKEKFDSVHSKYMGRTSFDSDSWTLRLHNLQIKDKGLYQCIIHHKKPTGMIRIHHMNSELSVLANFSQPEIVPISNITENVYINLTCSSIHGYPEPKKMSVLLRTKNSTIEYDGVMQKSQDNVTELYDVSISLSVSFPDVTSNMTIFCILETDKTRLLSSPFSIELEDPQPPPDHIP

SEQ ID NO: 1173 - protein, 108 aa, synthetic construct
  REGION 1..108: note = CD86 WT IgV
APLKIQAYFNETADLPCQFANSQNQSLSELVVFWQDQENLVLNEVYLGKEKFDSVHSKYMGRTSFDSDSWTLRLHNLQIKDKGLYQCIIHHKKPTGMIRIHQMNSELS

SEQ ID NO: 1174 - protein, 108 aa, synthetic construct
  REGION 1..108: note = CD86 v1 IgV
APLKIQAYFNETADLPCQFANSQNQSLSELVVFWHDQENLVLNEVYLGKEKFDSVHSKYMGRTSFDSDSWTLRLHNLQIKDKGLYQCIILHKKPTGMIRIHHMNSELS

SEQ ID NO: 1175 - protein, 108 aa, synthetic construct
  REGION 1..108: note = CD86 v2 IgV
APLKIQAYFNETADLPCQFANSQNQSLSELVVFWHDQENLVLNEVYLGKEKFDSVHSKYMGRTSFDSDSWTLRLHNLQIKDKGLYQCIIHHKKPTGMIRIHQMNSELS

SEQ ID NO: 1176 - protein, 108 aa, synthetic construct
  REGION 1..108: note = CD86 v3 IgV
APLKIQAYFNETADLPCQFANSQNQSLSELVVFWQDQENLVLNEVYLGKEKFDSVHSKYMGRTSFDSDSWTLRLHNLQIKDKGLYQCIILHKKPTGMIRIHQMNSELS

SEQ ID NO: 1177 - protein, 108 aa, synthetic construct
  REGION 1..108: note = CD86 v4 IgV
APLKIQAYFNETADLPCQFANSQNQSLSELVVFWQDQENLVLNEVYLGKEKFDSVHSKYMGRTSFDSDSWTLRLHNLQIKDKGLYQCIIHHKKPTGMIRIHHMNSELS

SEQ ID NO: 1178 - protein, 229 aa, synthetic construct
  REGION 1..229: note = IgG4 Fc
ESKYGPPCPSCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 1179 - protein, 229 aa, synthetic construct
  REGION 1..229: note = IgG4 Fc S228P
ESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 1180 - protein, 232 aa, synthetic construct
  REGION 1..232: note = IgG1 Fc C220S
EPKSSDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1181 - protein, 15 aa, synthetic construct
  REGION 1..15: note = IgV-IgV linker
GGGGSGGGGSGGGGS

SEQ ID NO: 1182 - protein, 10 aa, synthetic construct
  REGION 1..10: note = IgV-Fc linker 1
GGGGSGGGGS

SEQ ID NO: 1183 - protein, 13 aa, synthetic construct
  REGION 1..13: note = IgV-Fc linker 2
GGGGSGGGGSAAA

SEQ ID NO: 1184 - protein, 116 aa, synthetic construct
  REGION 1..116: note = CD155 v120 IgV
PGTGDVVVQAPTQVSGFLGDSVTLPCYLQVPNMEVTHVSQLTWGRHGESGSMAVFHQTQGPSYSESKRLEFVAARPGAELRNASLRMSGLRVEDEGNYTCMFVAFPQGSWSVDIWL

SEQ ID NO: 1185 - protein, 116 aa, synthetic construct
  REGION 1..116: note = CD155 v121 IgV
PGTGDVVVQAPTQVTGFLGGAVTLPCYLQVPDMEVTHVSQLTWARLGESGSMAVFHQTQGPSYSESKRLEFVAARPGAELRNASLRMSGLRVEDEGNYTCMFVTFPQRSRSVDIWL

SEQ ID NO: 1186 - protein, 116 aa, synthetic construct
  REGION 1..116: note = CD155 v122 IgV
PGTGDLVVQAPTQVSGFLGDSVTLPCYLQVPNMEVTHVSQLTWARHGESGSMAVFHRTQGPSYSESKRLEFLAARPGAELRNASLKMSGLRVEDEGNYTCEFVTFPQRSRSVDIWL

SEQ ID NO: 1187 - protein, 116 aa, synthetic construct
  REGION 1..116: note = CD155 v123 IgV
PGTGDVVVQAPTQVSGFLGDSVTLPCYLQVPNMEVTHVSQLTWARRGESGSMAVFHQTQGPSYSESKRLDFVAARPGAELRDASLRMSGLRAEDEGNYTCMFVTFPQRSRSVDIWL

SEQ ID NO: 1188 - protein, 116 aa, synthetic construct
  REGION 1..116: note = CD155 v124 IgV
PGTGDVVAQAPTQVSGFLGDSVTLPCYLQVPNMEVTHVSQLTWARHGESGSMAVFHQTQGPSYSESKRLEFVAARPGAELRNASLRMSGLRVEDEGNYTCMFVTFPQRSRSVDIWL

SEQ ID NO: 1189 - protein, 116 aa, synthetic construct
  REGION 1..116: note = CD155 v125 IgV
PGTGDVVAQAPTQVSGFLGDSVTLPCYLQVPNMEVTHVSQLTWARHGESGRMAVFHPTKGPSYSESKRLEFVAARPGAELRDASLRMSGLRVEDEGNYTCLFVMFPQGSRSVDIWL

SEQ ID NO: 1190 - protein, 116 aa, synthetic construct
  REGION 1..116: note = CD155 v126 IgV
PGTGDVVVQAPTQVTGFLGDSVTLPCYLQVPNMEVTHVSQLTWARHGEPGSMAVFHQTQGPAYVESKRLEFVAARPGAELRNASLRMSGLRVEDEGNYTCMFVTFPQRSRSVDIWL

SEQ ID NO: 1191 - protein, 116 aa, synthetic construct
  REGION 1..116: note = CD155 v127 IgV
PGTGDVVVQAPTQVTGFLGDSVTLPCYLQVPNTEVTHVSQLTWARHGESGSMAVFHQTQGPSYSESKRLEFVAARPGAELRNASLRMSGLRVEDEGNYTCLFVTFPQRSRSVDIWL

SEQ ID NO: 1192 - protein, 116 aa, synthetic construct
  REGION 1..116: note = CD155 v128 IgV
PGTGGVVVQAPTQVSGFLGDSVTLPCYLQVPNIEATHVSQLTWARQGESGSMAVFHQTQGPSYSESKRLEFVEARLGAELRNASLRMSGLRVEDEGNYTCMFVAFPQGSWSVDIWL

SEQ ID NO: 1193 - protein, 116 aa, synthetic construct
  REGION 1..116: note = CD155 v129 IgV
PGTGDVVVQAPTQVSGFLGDSVTLPCYLQVPNMEVTHVSQLTWARHGEPGSMAVFHQTQGPAYVESKRLEFVAARPGAELRNASLRMSGLRVEDEGNYTCMFVSFPQGSWSVDIWL

SEQ ID NO: 1194 - protein, 116 aa, synthetic construct
  REGION 1..116: note = CD155 v130 IgV
PGTGDVVVQAPIQVTGFLGDSVTLPCYLQVPNMEVTHVSQLTWARHGESGSMAVFHQTQGPSYSESKRLEFVAARPGAELRNASLRMSGLRVEDEGNYTCMFVTFPQRSRSVDIWL

SEQ ID NO: 1195 - protein, 116 aa, synthetic construct
  REGION 1..116: note = CD155 v131 IgV
PGTGDVVVQAPTQVFGFLGDSVMLPCYLQVPNMEVTHVSQVTWARHGESGSMAVFHQTKGPSYSESKRLEFVAARPGADLRNASLRMSGLRVEDEGNYTCMFVTFPQDSRSVDIWL

SEQ ID NO: 1196 - protein, 116 aa, synthetic construct
  REGION 1..116: note = CD155 v132 IgV
PGTGDVVVQAPTQVTGFLGDSVTLPCYLQVPNMGVTHVSQLTWARHGESRSMAVFHQTKGPSYSESKRLEFVAARPGAELRNASLRMSGLRVEDDGNYTCMFVMFPQGSRSVDIWL

SEQ ID NO: 1197 - protein, 116 aa, synthetic construct
  REGION 1..116: note = CD155 v133 IgV
PGTGDVVVQAPTQVLGFLGDSVTLPCYLQVPNMEVTHVSQLTWARHGESGSMAVFHQTQGPSYSESERLEFVAARPGAELRNASLRMSGLRAEDEGNYTCLFVTFPQRSRSVDIWL

SEQ ID NO: 1198 - protein, 116 aa, synthetic construct
  REGION 1..116: note = CD155 v134 IgV
PGTGDIVVKAPTQVFGFLGDSVTLPCYLQVPNMEVTHVSQLTWARHGESGSMAVFHQTQGPAYVESKRLEFVAARPGAELRNASLRMFGLRVEDEGNYTCTFVTFPQRIRSVDIWL

SEQ ID NO: 1199 - protein, 116 aa, synthetic construct
  REGION 1..116: note = CD155 v135 IgV
PGTGDVVVQAPTQVFGFLGDSVTLPCYLQVPNMEVTHVSQLTWARHGESGSMAVFHQTQGPAYVESKRLEFVAARLGAELRNASLRMSGLRVEDEGNYTCMFVTFPQRSRSVDIWL

SEQ ID NO: 1200 - protein, 116 aa, synthetic construct
  REGION 1..116: note = CD155 v136 IgV
PGTGDIIVQAPTQVSGSLGDSVTLPCYLQVPNMEVTHVSQLAWARHGESGSMAVFHQTQGPSYSESKRLEFVAARPGAELRNASLRMSGLRVEDEGNYTCMFVTYPQRVRSVDIWL

SEQ ID NO: 1201 - protein, 116 aa, synthetic construct
  REGION 1..116: note = CD155 v137 IgV
PGTGDLVVQAPTQVLGFLGDSVTLPCYLQVPNMEVTHVSQLTWARHGESGSMAVFHQTQGPSYSESKRLEFVAARPGAELRNASLRISGLRVEDEGNYSCMFVTFPQRSRSVDIWL

SEQ ID NO: 1202 - protein, 116 aa, synthetic construct
  REGION 1..116: note = CD155 v138 IgV
PGTGDVVVQAPTQVCGFLGDSVMLPCYLQVPNMEVTHVSQVTWARHGESGSIAVFHQTKGPSYSESKRLEFVAARPGAELRNASLRMSGLRVEDEGNYTCMFVMFPQGSRSVDIWL

SEQ ID NO: 1203 - protein, 116 aa, synthetic construct
  REGION 1..116: note = CD155 v139 IgV
PGTGDIVVQAPTQVTGFLGGSVTLPCYLQVPNMEVTHVSQLTWARHGESGSMAVFHQTQGPSYSESKRLEFVAARPGAELRNASLRMSGLRVEDEGNYTCLFVTFPQRSRSVDIWL

SEQ ID NO: 1204 - protein, 116 aa, synthetic construct
  REGION 1..116: note = CD155 v140 IgV
PGTGDVVVQAPTQVFGFLGDSVTLPCYLQVPNMEVTHVSQLTWARHGESGSMAVFHQTQGPSYSESKRLEFVAARPGAELRNASLRLSGLRAEDEGNYTCMFVTFPQRSRSVDIWL

SEQ ID NO: 1205 - protein, 116 aa, synthetic construct
  REGION 1..116: note = CD155 v141 IgV
PGTGDVVVQAPTQVTGFLGDSVTLPCYLQVPNTEVTHVSQLTWARHGESGSMAVFHQTQGPAYEESKRLEFVAARQGTELRNASLRMSGLRVEDEGNYTCLFVTFPQRSRSVDIWL

SEQ ID NO: 1206 - protein, 116 aa, synthetic construct
  REGION 1..116: note = CD155 v142 IgV
PGTGDLVVQAPTQVTGFLGDSVTLPCYLQVPNMEVTHVSQLTWARHGESGSMAVFHQTRGPSYSESKRLEFVAARPGAELRNASLRMSGLRVEDEGNYTCMFVTFPQRSRSVDIWL

SEQ ID NO: 1207 - protein, 122 aa, synthetic construct
  REGION 1..122: note = CD155 v120 IgV
WPPPGTGDVVVQAPTQVSGFLGDSVTLPCYLQVPNMEVTHVSQLTWGRHGESGSMAVFHQTQGPSYSESKRLEFVAARPGAELRNASLRMSGLRVEDEGNYTCMFVAFPQGSWSVDIWLRVL

SEQ ID NO: 1208 - protein, 122 aa, synthetic construct
  REGION 1..122: note = CD155 v121 IgV
WPPPGTGDVVVQAPTQVTGFLGGAVTLPCYLQVPDMEVTHVSQLTWARLGESGSMAVFHQTQGPSYSESKRLEFVAARPGAELRNASLRMSGLRVEDEGNYTCMFVTFPQRSRSVDIWLRVL

SEQ ID NO: 1209 - protein, 122 aa, synthetic construct
  REGION 1..122: note = CD155 v122 IgV
WPPPGTGDLVVQAPTQVSGFLGDSVTLPCYLQVPNMEVTHVSQLTWARHGESGSMAVFHRTQGPSYSESKRLEFLAARPGAELRNASLKMSGLRVEDEGNYTCEFVTFPQRSRSVDIWLRVL

SEQ ID NO: 1210 - protein, 122 aa, synthetic construct
  REGION 1..122: note = CD155 v123 IgV
WPPPGTGDVVVQAPTQVSGFLGDSVTLPCYLQVPNMEVTHVSQLTWARRGESGSMAVFHQTQGPSYSESKRLDFVAARPGAELRDASLRMSGLRAEDEGNYTCMFVTFPQRSRSVDIWLRVL

SEQ ID NO: 1211 - protein, 122 aa, synthetic construct
  REGION 1..122: note = CD155 v124 IgV
WPPPGTGDVVAQAPTQVSGFLGDSVTLPCYLQVPNMEVTHVSQLTWARHGESGSMAVFHQTQGPSYSESKRLEFVAARPGAELRNASLRMSGLRVEDEGNYTCMFVTFPQRSRSVDIWLRVL

SEQ ID NO: 1212 - protein, 122 aa, synthetic construct
  REGION 1..122: note = CD155 v125 IgV
WPPPGTGDVVAQAPTQVSGFLGDSVTLPCYLQVPNMEVTHVSQLTWARHGESGRMAVFHPTKGPSYSESKRLEFVAARPGAELRDASLRMSGLRVEDEGNYTCLFVMFPQGSRSVDIWLRVL

SEQ ID NO: 1213 - protein, 122 aa, synthetic construct
  REGION 1..122: note = CD155 v126 IgV
WPPPGTGDVVVQAPTQVTGFLGDSVTLPCYLQVPNMEVTHVSQLTWARHGEPGSMAVFHQTQGPAYVESKRLEFVAARPGAELRNASLRMSGLRVEDEGNYTCMFVTFPQRSRSVDIWLRVL

SEQ ID NO: 1214 - protein, 122 aa, synthetic construct
  REGION 1..122: note = CD155 v127 IgV
WPPPGTGDVVVQAPTQVTGFLGDSVTLPCYLQVPNTEVTHVSQLTWARHGESGSMAVFHQTQGPSYSESKRLEFVAARPGAELRNASLRMSGLRVEDEGNYTCLFVTFPQRSRSVDIWLRVL

SEQ ID NO: 1215 - protein, 122 aa, synthetic construct
  REGION 1..122: note = CD155 v128 IgV
WPPPGTGGVVVQAPTQVSGFLGDSVTLPCYLQVPNIEATHVSQLTWARQGESGSMAVFHQTQGPSYSESKRLEFVEARLGAELRNASLRMSGLRVEDEGNYTCMFVAFPQGSWSVDIWLRVL

SEQ ID NO: 1216 - protein, 122 aa, synthetic construct
  REGION 1..122: note = CD155 v129 IgV
WPPPGTGDVVVQAPTQVSGFLGDSVTLPCYLQVPNMEVTHVSQLTWARHGEPGSMAVFHQTQGPAYVESKRLEFVAARPGAELRNASLRMSGLRVEDEGNYTCMFVSFPQGSWSVDIWLRVL

SEQ ID NO: 1217 - protein, 122 aa, synthetic construct
  REGION 1..122: note = CD155 v130 IgV
WPPPGTGDVVVQAPIQVTGFLGDSVTLPCYLQVPNMEVTHVSQLTWARHGESGSMAVFHQTQGPSYSESKRLEFVAARPGAELRNASLRMSGLRVEDEGNYTCMFVTFPQRSRSVDIWLRVL

SEQ ID NO: 1218 - protein, 122 aa, synthetic construct
  REGION 1..122: note = CD155 v131 IgV
WPPPGTGDVVVQAPTQVFGFLGDSVMLPCYLQVPNMEVTHVSQVTWARHGESGSMAVFHQTKGPSYSESKRLEFVAARPGADLRNASLRMSGLRVEDEGNYTCMFVTFPQDSRSVDIWLRVL

SEQ ID NO: 1219 - protein, 122 aa, synthetic construct
  REGION 1..122: note = CD155 v132 IgV
WPPPGTGDVVVQAPTQVTGFLGDSVTLPCYLQVPNMGVTHVSQLTWARHGESRSMAVFHQTKGPSYSESKRLEFVAARPGAELRNASLRMSGLRVEDDGNYTCMFVMFPQGSRSVDIWLRVL

SEQ ID NO: 1220 - protein, 122 aa, synthetic construct
  REGION 1..122: note = CD155 v133 IgV
WPPPGTGDVVVQAPTQVLGFLGDSVTLPCYLQVPNMEVTHVSQLTWARHGESGSMAVFHQTQGPSYSESERLEFVAARPGAELRNASLRMSGLRAEDEGNYTCLFVTFPQRSRSVDIWLRVL

SEQ ID NO: 1221 - protein, 122 aa, synthetic construct
  REGION 1..122: note = CD155 v134 IgV
WPPPGTGDIVVKAPTQVFGFLGDSVTLPCYLQVPNMEVTHVSQLTWARHGESGSMAVFHQTQGPAYVESKRLEFVAARPGAELRNASLRMFGLRVEDEGNYTCTFVTFPQRIRSVDIWLRVL

SEQ ID NO: 1222 - protein, 122 aa, synthetic construct
  REGION 1..122: note = CD155 v135 IgV
WPPPGTGDVVVQAPTQVFGFLGDSVTLPCYLQVPNMEVTHVSQLTWARHGESGSMAVFHQTQGPAYVESKRLEFVAARLGAELRNASLRMSGLRVEDEGNYTCMFVTFPQRSRSVDIWLRVL

SEQ ID NO: 1223 - protein, 122 aa, synthetic construct
  REGION 1..122: note = CD155 v136 IgV
WPPPGTGDIIVQAPTQVSGSLGDSVTLPCYLQVPNMEVTHVSQLAWARHGESGSMAVFHQTQGPSYSESKRLEFVAARPGAELRNASLRMSGLRVEDEGNYTCMFVTYPQRVRSVDIWLRVL

SEQ ID NO: 1224 - protein, 122 aa, synthetic construct
  REGION 1..122: note = CD155 v137 IgV
WPPPGTGDLVVQAPTQVLGFLGDSVTLPCYLQVPNMEVTHVSQLTWARHGESGSMAVFHQTQGPSYSESKRLEFVAARPGAELRNASLRISGLRVEDEGNYSCMFVTFPQRSRSVDIWLRVL

SEQ ID NO: 1225 - protein, 122 aa, synthetic construct
  REGION 1..122: note = CD155 v138 IgV
WPPPGTGDVVVQAPTQVCGFLGDSVMLPCYLQVPNMEVTHVSQVTWARHGESGSIAVFHQTKGPSYSESKRLEFVAARPGAELRNASLRMSGLRVEDEGNYTCMFVMFPQGSRSVDIWLRVL

SEQ ID NO: 1226 - protein, 122 aa, synthetic construct
  REGION 1..122: note = CD155 v139 IgV
WPPPGTGDIVVQAPTQVTGFLGGSVTLPCYLQVPNMEVTHVSQLTWARHGESGSMAVFHQTQGPSYSESKRLEFVAARPGAELRNASLRMSGLRVEDEGNYTCLFVTFPQRSRSVDIWLRVL

SEQ ID NO: 1227 - protein, 122 aa, synthetic construct
  REGION 1..122: note = CD155 v140 IgV
WPPPGTGDVVVQAPTQVFGFLGDSVTLPCYLQVPNMEVTHVSQLTWARHGESGSMAVFHQTQGPSYSESKRLEFVAARPGAELRNASLRLSGLRAEDEGNYTCMFVTFPQRSRSVDIWLRVL

SEQ ID NO: 1228 - protein, 122 aa, synthetic construct
  REGION 1..122: note = CD155 v141 IgV
WPPPGTGDVVVQAPTQVTGFLGDSVTLPCYLQVPNTEVTHVSQLTWARHGESGSMAVFHQTQGPAYEESKRLEFVAARQGTELRNASLRMSGLRVEDEGNYTCLFVTFPQRSRSVDIWLRVL

SEQ ID NO: 1229 - protein, 122 aa, synthetic construct
  REGION 1..122: note = CD155 v142 IgV
WPPPGTGDLVVQAPTQVTGFLGDSVTLPCYLQVPNMEVTHVSQLTWARHGESGSMAVFHQTRGPSYSESKRLEFVAARPGAELRNASLRMSGLRVEDEGNYTCMFVTFPQRSRSVDIWLRVL

SEQ ID NO: 1230 - protein, 323 aa, synthetic construct
  REGION 1..323: note = CD155 v120 ECD
WPPPGTGDVVVQAPTQVSGFLGDSVTLPCYLQVPNMEVTHVSQLTWGRHGESGSMAVFHQTQGPSYSESKRLEFVAARPGAELRNASLRMSGLRVEDEGNYTCMFVAFPQGSWSVDIWLRVLAKPQNTAEVQKVQLTGEPVPMARCVSTGGRPPAQITWHSDLGGMPNTSQVPGFLSGTVTVTSLWILVPSSQVDGKNVTCKVEHESFEKPQLLTVNLTVYYPPEVSISGYDNNWYLGQNEATLTCDARSNPEPTGYNWSTTMGPLPPFAVAQGAQLLIRPVDKPINTTLICNVTNALGARQAELTVQVKEGPPSEHSGISRN

SEQ ID NO: 1231 - protein, 323 aa, synthetic construct
  REGION 1..323: note = CD155 v121 ECD
WPPPGTGDVVVQAPTQVTGFLGGAVTLPCYLQVPDMEVTHVSQLTWARLGESGSMAVFHQTQGPSYSESKRLEFVAARPGAELRNASLRMSGLRVEDEGNYTCMFVTFPQRSRSVDIWLRVLAKPQNTAEVQKVQLTGEPVPMARCVSTGGRPPAQITWHSDLGGMPNTSQVPGFLSGTVTVTSLWILVPSSQVDGKNVTCKVEHESFEKPQLLTVNLTVYYPPEVSISGYDNNWYLGQNEATLTCDARSNPEPTGYNWSTTMGPLPPFAVAQGAQLLIRPVDKPINTTLICNVTNALGARQAELTVQVKEGPPSEHSGISRN

SEQ ID NO: 1232 - protein, 323 aa, synthetic construct
  REGION 1..323: note = CD155 v122 ECD
WPPPGTGDLVVQAPTQVSGFLGDSVTLPCYLQVPNMEVTHVSQLTWARHGESGSMAVFHRTQGPSYSESKRLEFLAARPGAELRNASLKMSGLRVEDEGNYTCEFVTFPQRSRSVDIWLRVLAKPQNTAEVQKVQLTGEPVPMARCVSTGGRPPAQITWHSDLGGMPNTSQVPGFLSGTVTVTSLWILVPSSQVDGKNVTCKVEHESFEKPQLLTVNLTVYYPPEVSISGYDNNWYLGQNEATLTCDARSNPEPTGYNWSTTMGPLPPFAVAQGAQLLIRPVDKPINTTLICNVTNALGARQAELTVQVKEGPPSEHSGISRN

SEQ ID NO: 1233 - protein, 323 aa, synthetic construct
  REGION 1..323: note = CD155 v123 ECD
WPPPGTGDVVVQAPTQVSGFLGDSVTLPCYLQVPNMEVTHVSQLTWARRGESGSMAVFHQTQGPSYSESKRLDFVAARPGAELRDASLRMSGLRAEDEGNYTCMFVTFPQRSRSVDIWLRVLAKPQNTAEVQKVQLTGEPVPMARCVSTGGRPPAQITWHSDLGGMPNTSQVPGFLSGTVTVTSLWILVPSSQVDGKNVTCKVEHESFEKPQLLTVNLTVYYPPEVSISGYDNNWYLGQNEATLTCDARSNPEPTGYNWSTTMGPLPPFAVAQGAQLLIRPVDKPINTTLICNVTNALGARQAELTVQVKEGPPSEHSGISRN

SEQ ID NO: 1234 - protein, 323 aa, synthetic construct
  REGION 1..323: note = CD155 v124 ECD
WPPPGTGDVVAQAPTQVSGFLGDSVTLPCYLQVPNMEVTHVSQLTWARHGESGSMAVFHQTQGPSYSESKRLEFVAARPGAELRNASLRMSGLRVEDEGNYTCMFVTFPQRSRSVDIWLRVLAKPQNTAEVQKVQLTGEPVPMARCVSTGGRPPAQITWHSDLGGMPNTSQVPGFLSGTVTVTSLWILVPSSQVDGKNVTCKVEHESFEKPQLLTVNLTVYYPPEVSISGYDNNWYLGQNEATLTCDARSNPEPTGYNWSTTMGPLPPFAVAQGAQLLIRPVDKPINTTLICNVTNALGARQAELTVQVKEGPPSEHSGISRN

SEQ ID NO: 1235 - protein, 323 aa, synthetic construct
  REGION 1..323: note = CD155 v125 ECD
WPPPGTGDVVAQAPTQVSGFLGDSVTLPCYLQVPNMEVTHVSQLTWARHGESGRMAVFHPTKGPSYSESKRLEFVAARPGAELRDASLRMSGLRVEDEGNYTCLFVMFPQGSRSVDIWLRVLAKPQNTAEVQKVQLTGEPVPMARCVSTGGRPPAQITWHSDLGGMPNTSQVPGFLSGTVTVTSLWILVPSSQVDGKNVTCKVEHESFEKPQLLTVNLTVYYPPEVSISGYDNNWYLGQNEATLTCDARSNPEPTGYNWSTTMGPLPPFAVAQGAQLLIRPVDKPINTTLICNVTNALGARQAELTVQVKEGPPSEHSGISRN

SEQ ID NO: 1236 - protein, 323 aa, synthetic construct
  REGION 1..323: note = CD155 v126 ECD
WPPPGTGDVVVQAPTQVTGFLGDSVTLPCYLQVPNMEVTHVSQLTWARHGEPGSMAVFHQTQGPAYVESKRLEFVAARPGAELRNASLRMSGLRVEDEGNYTCMFVTFPQRSRSVDIWLRVLAKPQNTAEVQKVQLTGEPVPMARCVSTGGRPPAQITWHSDLGGMPNTSQVPGFLSGTVTVTSLWILVPSSQVDGKNVTCKVEHESFEKPQLLTVNLTVYYPPEVSISGYDNNWYLGQNEATLTCDARSNPEPTGYNWSTTMGPLPPFAVAQGAQLLIRPVDKPINTTLICNVTNALGARQAELTVQVKEGPPSEHSGISRN

SEQ ID NO: 1237 - protein, 323 aa, synthetic construct
  REGION 1..323: note = CD155 v127 ECD
WPPPGTGDVVVQAPTQVTGFLGDSVTLPCYLQVPNTEVTHVSQLTWARHGESGSMAVFHQTQGPSYSESKRLEFVAARPGAELRNASLRMSGLRVEDEGNYTCLFVTFPQRSRSVDIWLRVLAKPQNTAEVQKVQLTGEPVPMARCVSTGGRPPAQITWHSDLGGMPNTSQVPGFLSGTVTVTSLWILVPSSQVDGKNVTCKVEHESFEKPQLLTVNLTVYYPPEVSISGYDNNWYLGQNEATLTCDARSNPEPTGYNWSTTMGPLPPFAVAQGAQLLIRPVDKPINTTLICNVTNALGARQAELTVQVKEGPPSEHSGISRN

SEQ ID NO: 1238 - protein, 323 aa, synthetic construct
  REGION 1..323: note = CD155 v128 ECD
WPPPGTGGVVVQAPTQVSGFLGDSVTLPCYLQVPNIEATHVSQLTWARQGESGSMAVFHQTQGPSYSESKRLEFVEARLGAELRNASLRMSGLRVEDEGNYTCMFVAFPQGSWSVDIWLRVLAKPQNTAEVQKVQLTGEPVPMARCVSTGGRPPAQITWHSDLGGMPNTSQVPGFLSGTVTVTSLWILVPSSQVDGKNVTCKVEHESFEKPQLLTVNLTVYYPPEVSISGYDNNWYLGQNEATLTCDARSNPEPTGYNWSTTMGPLPPFAVAQGAQLLIRPVDKPINTTLICNVTNALGARQAELTVQVKEGPPSEHSGISRN

SEQ ID NO: 1239 - protein, 323 aa, synthetic construct
  REGION 1..323: note = CD155 v129 ECD
WPPPGTGDVVVQAPTQVSGFLGDSVTLPCYLQVPNMEVTHVSQLTWARHGEPGSMAVFHQTQGPAYVESKRLEFVAARPGAELRNASLRMSGLRVEDEGNYTCMFVSFPQGSWSVDIWLRVLAKPQNTAEVQKVQLTGEPVPMARCVSTGGRPPAQITWHSDLGGMPNTSQVPGFLSGTVTVTSLWILVPSSQVDGKNVTCKVEHESFEKPQLLTVNLTVYYPPEVSISGYDNNWYLGQNEATLTCDARSNPEPTGYNWSTTMGPLPPFAVAQGAQLLIRPVDKPINTTLICNVTNALGARQAELTVQVKEGPPSEHSGISRN

SEQ ID NO: 1240 - protein, 323 aa, synthetic construct
  REGION 1..323: note = CD155 v130 ECD
WPPPGTGDVVVQAPIQVTGFLGDSVTLPCYLQVPNMEVTHVSQLTWARHGESGSMAVFHQTQGPSYSESKRLEFVAARPGAELRNASLRMSGLRVEDEGNYTCMFVTFPQRSRSVDIWLRVLAKPQNTAEVQKVQLTGEPVPMARCVSTGGRPPAQITWHSDLGGMPNTSQVPGFLSGTVTVTSLWILVPSSQVDGKNVTCKVEHESFEKPQLLTVNLTVYYPPEVSISGYDNNWYLGQNEATLTCDARSNPEPTGYNWSTTMGPLPPFAVAQGAQLLIRPVDKPINTTLICNVTNALGARQAELTVQVKEGPPSEHSGISRN

SEQ ID NO: 1241 - protein, 323 aa, synthetic construct
  REGION 1..323: note = CD155 v131 ECD
WPPPGTGDVVVQAPTQVFGFLGDSVMLPCYLQVPNMEVTHVSQVTWARHGESGSMAVFHQTKGPSYSESKRLEFVAARPGADLRNASLRMSGLRVEDEGNYTCMFVTFPQDSRSVDIWLRVLAKPQNTAEVQKVQLTGEPVPMARCVSTGGRPPAQITWHSDLGGMPNTSQVPGFLSGTVTVTSLWILVPSSQVDGKNVTCKVEHESFEKPQLLTVNLTVYYPPEVSISGYDNNWYLGQNEATLTCDARSNPEPTGYNWSTTMGPLPPFAVAQGAQLLIRPVDKPINTTLICNVTNALGARQAELTVQVKEGPPSEHSGISRN

SEQ ID NO: 1242 - protein, 323 aa, synthetic construct
  REGION 1..323: note = CD155 v132 ECD
WPPPGTGDVVVQAPTQVTGFLGDSVTLPCYLQVPNMGVTHVSQLTWARHGESRSMAVFHQTKGPSYSESKRLEFVAARPGAELRNASLRMSGLRVEDDGNYTCMFVMFPQGSRSVDIWLRVLAKPQNTAEVQKVQLTGEPVPMARCVSTGGRPPAQITWHSDLGGMPNTSQVPGFLSGTVTVTSLWILVPSSQVDGKNVTCKVEHESFEKPQLLTVNLTVYYPPEVSISGYDNNWYLGQNEATLTCDARSNPEPTGYNWSTTMGPLPPFAVAQGAQLLIRPVDKPINTTLICNVTNALGARQAELTVQVKEGPPSEHSGISRN

SEQ ID NO: 1243 - protein, 323 aa, synthetic construct
  REGION 1..323: note = CD155 v133 ECD
WPPPGTGDVVVQAPTQVLGFLGDSVTLPCYLQVPNMEVTHVSQLTWARHGESGSMAVFHQTQGPSYSESERLEFVAARPGAELRNASLRMSGLRAEDEGNYTCLFVTFPQRSRSVDIWLRVLAKPQNTAEVQKVQLTGEPVPMARCVSTGGRPPAQITWHSDLGGMPNTSQVPGFLSGTVTVTSLWILVPSSQVDGKNVTCKVEHESFEKPQLLTVNLTVYYPPEVSISGYDNNWYLGQNEATLTCDARSNPEPTGYNWSTTMGPLPPFAVAQGAQLLIRPVDKPINTTLICNVTNALGARQAELTVQVKEGPPSEHSGISRN

SEQ ID NO: 1244 - protein, 323 aa, synthetic construct
  REGION 1..323: note = CD155 v134 ECD
WPPPGTGDIVVKAPTQVFGFLGDSVTLPCYLQVPNMEVTHVSQLTWARHGESGSMAVFHQTQGPAYVESKRLEFVAARPGAELRNASLRMFGLRVEDEGNYTCTFVTFPQRIRSVDIWLRVLAKPQNTAEVQKVQLTGEPVPMARCVSTGGRPPAQITWHSDLGGMPNTSQVPGFLSGTVTVTSLWILVPSSQVDGKNVTCKVEHESFEKPQLLTVNLTVYYPPEVSISGYDNNWYLGQNEATLTCDARSNPEPTGYNWSTTMGPLPPFAVAQGAQLLIRPVDKPINTTLICNVTNALGARQAELTVQVKEGPPSEHSGISRN

SEQ ID NO: 1245 - protein, 323 aa, synthetic construct
  REGION 1..323: note = CD155 v135 ECD
WPPPGTGDVVVQAPTQVFGFLGDSVTLPCYLQVPNMEVTHVSQLTWARHGESGSMAVFHQTQGPAYVESKRLEFVAARLGAELRNASLRMSGLRVEDEGNYTCMFVTFPQRSRSVDIWLRVLAKPQNTAEVQKVQLTGEPVPMARCVSTGGRPPAQITWHSDLGGMPNTSQVPGFLSGTVTVTSLWILVPSSQVDGKNVTCKVEHESFEKPQLLTVNLTVYYPPEVSISGYDNNWYLGQNEATLTCDARSNPEPTGYNWSTTMGPLPPFAVAQGAQLLIRPVDKPINTTLICNVTNALGARQAELTVQVKEGPPSEHSGISRN

SEQ ID NO: 1246 - protein, 323 aa, synthetic construct
  REGION 1..323: note = CD155 v136 ECD
WPPPGTGDIIVQAPTQVSGSLGDSVTLPCYLQVPNMEVTHVSQLAWARHGESGSMAVFHQTQGPSYSESKRLEFVAARPGAELRNASLRMSGLRVEDEGNYTCMFVTYPQRVRSVDIWLRVLAKPQNTAEVQKVQLTGEPVPMARCVSTGGRPPAQITWHSDLGGMPNTSQVPGFLSGTVTVTSLWILVPSSQVDGKNVTCKVEHESFEKPQLLTVNLTVYYPPEVSISGYDNNWYLGQNEATLTCDARSNPEPTGYNWSTTMGPLPPFAVAQGAQLLIRPVDKPINTTLICNVTNALGARQAELTVQVKEGPPSEHSGISRN

SEQ ID NO: 1247 - protein, 323 aa, synthetic construct
  REGION 1..323: note = CD155 v137 ECD
WPPPGTGDLVVQAPTQVLGFLGDSVTLPCYLQVPNMEVTHVSQLTWARHGESGSMAVFHQTQGPSYSESKRLEFVAARPGAELRNASLRISGLRVEDEGNYSCMFVTFPQRSRSVDIWLRVLAKPQNTAEVQKVQLTGEPVPMARCVSTGGRPPAQITWHSDLGGMPNTSQVPGFLSGTVTVTSLWILVPSSQVDGKNVTCKVEHESFEKPQLLTVNLTVYYPPEVSISGYDNNWYLGQNEATLTCDARSNPEPTGYNWSTTMGPLPPFAVAQGAQLLIRPVDKPINTTLICNVTNALGARQAELTVQVKEGPPSEHSGISRN

SEQ ID NO: 1248 - protein, 323 aa, synthetic construct
  REGION 1..323: note = CD155 v138 ECD
WPPPGTGDVVVQAPTQVCGFLGDSVMLPCYLQVPNMEVTHVSQVTWARHGESGSIAVFHQTKGPSYSESKRLEFVAARPGAELRNASLRMSGLRVEDEGNYTCMFVMFPQGSRSVDIWLRVLAKPQNTAEVQKVQLTGEPVPMARCVSTGGRPPAQITWHSDLGGMPNTSQVPGFLSGTVTVTSLWILVPSSQVDGKNVTCKVEHESFEKPQLLTVNLTVYYPPEVSISGYDNNWYLGQNEATLTCDARSNPEPTGYNWSTTMGPLPPFAVAQGAQLLIRPVDKPINTTLICNVTNALGARQAELTVQVKEGPPSEHSGISRN

SEQ ID NO: 1249 - protein, 323 aa, synthetic construct
  REGION 1..323: note = CD155 v139 ECD
WPPPGTGDIVVQAPTQVTGFLGGSVTLPCYLQVPNMEVTHVSQLTWARHGESGSMAVFHQTQGPSYSESKRLEFVAARPGAELRNASLRMSGLRVEDEGNYTCLFVTFPQRSRSVDIWLRVLAKPQNTAEVQKVQLTGEPVPMARCVSTGGRPPAQITWHSDLGGMPNTSQVPGFLSGTVTVTSLWILVPSSQVDGKNVTCKVEHESFEKPQLLTVNLTVYYPPEVSISGYDNNWYLGQNEATLTCDARSNPEPTGYNWSTTMGPLPPFAVAQGAQLLIRPVDKPINTTLICNVTNALGARQAELTVQVKEGPPSEHSGISRN

SEQ ID NO: 1250 - protein, 323 aa, synthetic construct
  REGION 1..323: note = CD155 v140 ECD
WPPPGTGDVVVQAPTQVFGFLGDSVTLPCYLQVPNMEVTHVSQLTWARHGESGSMAVFHQTQGPSYSESKRLEFVAARPGAELRNASLRLSGLRAEDEGNYTCMFVTFPQRSRSVDIWLRVLAKPQNTAEVQKVQLTGEPVPMARCVSTGGRPPAQITWHSDLGGMPNTSQVPGFLSGTVTVTSLWILVPSSQVDGKNVTCKVEHESFEKPQLLTVNLTVYYPPEVSISGYDNNWYLGQNEATLTCDARSNPEPTGYNWSTTMGPLPPFAVAQGAQLLIRPVDKPINTTLICNVTNALGARQAELTVQVKEGPPSEHSGISRN

SEQ ID NO: 1251 - protein, 323 aa, synthetic construct
  REGION 1..323: note = CD155 v141 ECD
WPPPGTGDVVVQAPTQVTGFLGDSVTLPCYLQVPNTEVTHVSQLTWARHGESGSMAVFHQTQGPAYEESKRLEFVAARQGTELRNASLRMSGLRVEDEGNYTCLFVTFPQRSRSVDIWLRVLAKPQNTAEVQKVQLTGEPVPMARCVSTGGRPPAQITWHSDLGGMPNTSQVPGFLSGTVTVTSLWILVPSSQVDGKNVTCKVEHESFEKPQLLTVNLTVYYPPEVSISGYDNNWYLGQNEATLTCDARSNPEPTGYNWSTTMGPLPPFAVAQGAQLLIRPVDKPINTTLICNVTNALGARQAELTVQVKEGPPSEHSGISRN

SEQ ID NO: 1252 - protein, 323 aa, synthetic construct
  REGION 1..323: note = CD155 v142 ECD
WPPPGTGDLVVQAPTQVTGFLGDSVTLPCYLQVPNMEVTHVSQLTWARHGESGSMAVFHQTRGPSYSESKRLEFVAARPGAELRNASLRMSGLRVEDEGNYTCMFVTFPQRSRSVDIWLRVLAKPQNTAEVQKVQLTGEPVPMARCVSTGGRPPAQITWHSDLGGMPNTSQVPGFLSGTVTVTSLWILVPSSQVDGKNVTCKVEHESFEKPQLLTVNLTVYYPPEVSISGYDNNWYLGQNEATLTCDARSNPEPTGYNWSTTMGPLPPFAVAQGAQLLIRPVDKPINTTLICNVTNALGARQAELTVQVKEGPPSEHSGISRN

SEQ ID NO: 1253 - protein, 231 aa, synthetic construct
  REGION 1..231: note = Stack Fc Lysine removed (homodimeric)
EPKSSDKTHTCPPCPAPEAEGAPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 1254 - protein, 494 aa, synthetic construct
  REGION 1..494: note = PD-L1/CD155 Stack 1 Fc fusion
WPPPGTGDVVVQAPTQVSGFLGDSVTLPCYLQVPNMEVTHVSQLTWARHGESGSMAVFHQTQGPWYAESKRLEFVAARLGAELRNASLRMFGLRVEDEGNYTCQFVTFPQRSRSVDIWLRVLGGGGSGGGGSEPKSSDKTHTCPPCPAPEAEGAPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGGSGGGGSFTVTVPKDLYVVEYGSNMTIECKFPVEKQLDLAALIVYWEMEGKDIIQFVHGEEDQKAQHSSYRQRARLLKDQLSLGNAALQITDVKLQDAGVYRCMISYGGGADYKRITVKVNA

SEQ ID NO: 1255 - protein, 494 aa, synthetic construct
  REGION 1..494: note = PD-L1/CD155 Stack 2 Fc fusion
FTVTVPKDLYVVEYGSNMTIECKFPVEKQLDLAALIVYWEMEGKDIIQFVHGEEDQKAQHSSYRQRARLLKDQLSLGNAALQITDVKLQDAGVYRCMISYGGGADYKRITVKVNAGGGGSGGGGSEPKSSDKTHTCPPCPAPEAEGAPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGGSGGGGSWPPPGTGDVVVQAPTQVSGFLGDSVTLPCYLQVPNMEVTHVSQLTWARHGESGSMAVFHQTQGPWYAESKRLEFVAARLGAELRNASLRMFGLRVEDEGNYTCQFVTFPQRSRSVDIWLRVL

SEQ ID NO: 1256 - protein, 494 aa, synthetic construct
  REGION 1..494: note = PD-L1/CD155 Stack 3 Fc fusion
WPPPGTGDVVVQAPTQVSGFLGDSVTLPCYLQVPNMEVTHVSQLTWARHGESGSMAVFHQTQGPWYAESKRLEFVAARLGAELRNASLRMFGLRVEDEGNYTCQFVTFPQRSRSVDIWLRVLGGGGSGGGGSGGGGSFTVTVPKDLYVVEYGSNMTIECKFPVEKQLDLAALIVYWEMEGKDIIQFVHGEEDQKAQHSSYRQRARLLKDQLSLGNAALQITDVKLQDAGVYRCMISYGGGADYKRITVKVNAGGGGSGGGGSEPKSSDKTHTCPPCPAPEAEGAPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1257 - protein, 494 aa, synthetic construct
  REGION 1..494: note = PD-L1/CD155 Stack 4 Fc fusion
FTVTVPKDLYVVEYGSNMTIECKFPVEKQLDLAALIVYWEMEGKDIIQFVHGEEDQKAQHSSYRQRARLLKDQLSLGNAALQITDVKLQDAGVYRCMISYGGGADYKRITVKVNAGGGGSGGGGSGGGGSWPPPGTGDVVVQAPTQVSGFLGDSVTLPCYLQVPNMEVTHVSQLTWARHGESGSMAVFHQTQGPWYAESKRLEFVAARLGAELRNASLRMFGLRVEDEGNYTCQFVTFPQRSRSVDIWLRVLGGGGSGGGGSEPKSSDKTHTCPPCPAPEAEGAPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1258 - protein, 507 aa, synthetic construct
  REGION 1..507: note = PD-L1/CD155 Stack 5 Fc fusion
HMSSVSAQEPKSSDKTHTCPPCPAPEAEGAPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGGSGGGGSWPPPGTGDVVVQAPTQVSGFLGDSVTLPCYLQVPNMEVTHVSQLTWARHGESGSMAVFHQTQGPWYAESKRLEFVAARLGAELRNASLRMFGLRVEDEGNYTCQFVTFPQRSRSVDIWLRVLGGGGSGGGGSGGGGSFTVTVPKDLYVVEYGSNMTIECKFPVEKQLDLAALIVYWEMEGKDIIQFVHGEEDQKAQHSSYRQRARLLKDQLSLGNAALQITDVKLQDAGVYRCMISYGGGADYKRITVKVNA

SEQ ID NO: 1259 - protein, 507 aa, synthetic construct
  REGION 1..507: note = PD-L1/CD155 Stack 6 Fc fusion
HMSSVSAQEPKSSDKTHTCPPCPAPEAEGAPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGGSGGGGSFTVTVPKDLYVVEYGSNMTIECKFPVEKQLDLAALIVYWEMEGKDIIQFVHGEEDQKAQHSSYRQRARLLKDQLSLGNAALQITDVKLQDAGVYRCMISYGGGADYKRITVKVNAGGGGSGGGGSGGGGSWPPPGTGDVVVQAPTQVSGFLGDSVTLPCYLQVPNMEVTHVSQLTWARHGESGSMAVFHQTQGPWYAESKRLEFVAARLGAELRNASLRMFGLRVEDEGNYTCQFVTFPQRSRSVDIWLRVL

SEQ ID NO: 1260 - protein, 505 aa, synthetic construct
  REGION 1..505: note = CD112/CD155 Stack 1 Fc fusion
WPPPGTGDVVVQAPTQVSGFLGDSVTLPCYLQVPNMEVTHVSQLTWARHGESGSMAVFHQTQGPWYAESKRLEFVAARLGAELRNASLRMFGLRVEDEGNYTCQFVTFPQRSRSVDIWLRVLGGGGSGGGGSEPKSSDKTHTCPPCPAPEAEGAPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGGGGGSGGGGSGGGGSQDVRVQVLPEVRGQLGGTVELPCHLLPPVPGLYISLVTWQRPDAPANHQNVAAFHPKMGPSFPSPKPGSERLSFVSAKQSTGQDTEAELQDATLALHGLTVEDEGNYTCEFATFPKGFVRGMTWLRV

SEQ ID NO: 1261 - protein, 505 aa, synthetic construct
  REGION 1..505: note = CD112/CD155 Stack 2 Fc fusion
QDVRVQVLPEVRGQLGGTVELPCHLLPPVPGLYISLVTWQRPDAPANHQNVAAFHPKMGPSFPSPKPGSERLSFVSAKQSTGQDTEAELQDATLALHGLTVEDEGNYTCEFATFPKGFVRGMTWLRVGGGGSGGGGSEPKSSDKTHTCPPCPAPEAEGAPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGGGGGSGGGGSGGGGSWPPPGTGDVVVQAPTQVSGFLGDSVTLPCYLQVPNMEVTHVSQLTWARHGESGSMAVFHQTQGPWYAESKRLEFVAARLGAELRNASLRMFGLRVEDEGNYTCQFVTFPQRSRSVDIWLRVL

SEQ ID NO: 1262 - protein, 506 aa, synthetic construct
  REGION 1..506: note = CD112/CD155 Stack 3 Fc fusion
WPPPGTGDVVVQAPTQVSGFLGDSVTLPCYLQVPNMEVTHVSQLTWARHGESGSMAVFHQTQGPWYAESKRLEFVAARLGAELRNASLRMFGLRVEDEGNYTCQFVTFPQRSRSVDIWLRVLGGGGSGGGGSGGGGSQDVRVQVLPEVRGQLGGTVELPCHLLPPVPGLYISLVTWQRPDAPANHQNVAAFHPKMGPSFPSPKPGSERLSFVSAKQSTGQDTEAELQDATLALHGLTVEDEGNYTCEFATFPKGFVRGMTWLRVGGGGSGGGGSEPKSSDKTHTCPPCPAPEAEGAPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1263 - protein, 506 aa, synthetic construct
  REGION 1..506: note = CD112/CD155 Stack 4 Fc fusion
QDVRVQVLPEVRGQLGGTVELPCHLLPPVPGLYISLVTWQRPDAPANHQNVAAFHPKMGPSFPSPKPGSERLSFVSAKQSTGQDTEAELQDATLALHGLTVEDEGNYTCEFATFPKGFVRGMTWLRVGGGGSGGGGSGGGGSWPPPGTGDVVVQAPTQVSGFLGDSVTLPCYLQVPNMEVTHVSQLTWARHGESGSMAVFHQTQGPWYAESKRLEFVAARLGAELRNASLRMFGLRVEDEGNYTCQFVTFPQRSRSVDIWLRVLGGGGSGGGGSEPKSSDKTHTCPPCPAPEAEGAPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1264 - protein, 518 aa, synthetic construct
  REGION 1..518: note = CD112/CD155 Stack 5 Fc fusion
HMSSVSAQEPKSSDKTHTCPPCPAPEAEGAPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGGGGGSGGGGSGGGGSQDVRVQVLPEVRGQLGGTVELPCHLLPPVPGLYISLVTWQRPDAPANHQNVAAFHPKMGPSFPSPKPGSERLSFVSAKQSTGQDTEAELQDATLALHGLTVEDEGNYTCEFATFPKGFVRGMTWLRVGGGGSGGGGSGGGGSWPPPGTGDVVVQAPTQVSGFLGDSVTLPCYLQVPNMEVTHVSQLTWARHGESGSMAVFHQTQGPWYAESKRLEFVAARLGAELRNASLRMFGLRVEDEGNYTCQFVTFPQRSRSVDIWLRVL

SEQ ID NO: 1265 - protein, 518 aa, synthetic construct
  REGION 1..518: note = CD112/CD155 Stack 6 Fc fusion
HMSSVSAQEPKSSDKTHTCPPCPAPEAEGAPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGGGGGSGGGGSGGGGSWPPPGTGDVVVQAPTQVSGFLGDSVTLPCYLQVPNMEVTHVSQLTWARHGESGSMAVFHQTQGPWYAESKRLEFVAARLGAELRNASLRMFGLRVEDEGNYTCQFVTFPQRSRSVDIWLRVLGGGGSGGGGSGGGGSQDVRVQVLPEVRGQLGGTVELPCHLLPPVPGLYISLVTWQRPDAPANHQNVAAFHPKMGPSFPSPKPGSERLSFVSAKQSTGQDTEAELQDATLALHGLTVEDEGNYTCEFATFPKGFVRGMTWLRV

SEQ ID NO: 1266 - protein, 635 aa, synthetic construct
  REGION 1..635: note = PD-L1/CD112/CD155 Stack 1 Fc fusion
FTVTVPKDLYVVEYGSNMTIECKFPVEKQLDLAALIVYWEMEGKDIIQFVHGEEDQKAQHSSYRQRARLLKDQLSLGNAALQITDVKLQDAGVYRCMISYGGGADYKRITVKVNAGGGGSGGGGSGGGGSWPPPGTGDVVVQAPTQVSGFLGDSVTLPCYLQVPNMEVTHVSQLTWARHGESGSMAVFHQTQGPWYAESKRLEFVAARLGAELRNASLRMFGLRVEDEGNYTCQFVTFPQRSRSVDIWLRVLGGGGSGGGGSEPKSSDKTHTCPPCPAPEAEGAPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGGGGGSGGGGSGGGGSQDVRVQVLPEVRGQLGGTVELPCHLLPPVPGLYISLVTWQRPDAPANHQNVAAFHPKMGPSFPSPKPGSERLSFVSAKQSTGQDTEAELQDATLALHGLTVEDEGNYTCEFATFPKGFVRGMTWLRV

SEQ ID NO: 1267 - protein, 635 aa, synthetic construct
  REGION 1..635: note = PD-L1/CD112/CD155 Stack 2 Fc fusion
FTVTVPKDLYVVEYGSNMTIECKFPVEKQLDLAALIVYWEMEGKDIIQFVHGEEDQKAQHSSYRQRARLLKDQLSLGNAALQITDVKLQDAGVYRCMISYGGGADYKRITVKVNAGGGGSGGGGSGGGGSWPPPGTGDVVVQAPTQVSGFLGDSVTLPCYLQVPNMEVTHVSQLTWARHGESGSMAVFHQTQGPWYAESKRLEFVAARLGAELRNASLRMFGLRVEDEGNYTCQFVTFPQRSRSVDIWLRVLGGGGSGGGGSGGGSQDVRVQVLPEVRGQLGGTVELPCHLLPPVPGLYISLVTWQRPDAPANHQNVAAFHPKMGPSFPSPKPGSERLSFVSAKQSTGQDTEAELQDATLALHGLTVEDEGNYTCEFATFPKGFVRGMTWLRVGGGGSGGGGSEPKSSDKTHTCPPCPAPEAEGAPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1268 - protein, 636 aa, synthetic construct
  REGION 1..636: note = PD-L1/CD112/CD155 Stack 3 Fc fusion
FTVTVPKDLYVVEYGSNMTIECKFPVEKQLDLAALIVYWEMEGKDIIQFVHGEEDQKAQHSSYRQRARLLKDQLSLGNAALQITDVKLQDAGVYRCMISYGGGADYKRITVKVNAGGGGSGGGGSGGGGSQDVRVQVLPEVRGQLGGTVELPCHLLPPVPGLYISLVTWQRPDAPANHQNVAAFHPKMGPSFPSPKPGSERLSFVSAKQSTGQDTEAELQDATLALHGLTVEDEGNYTCEFATFPKGFVRGMTWLRVGGGGSGGGGSGGGGSWPPPGTGDVVVQAPTQVSGFLGDSVTLPCYLQVPNMEVTHVSQLTWARHGESGSMAVFHQTQGPWYAESKRLEFVAARLGAELRNASLRMFGLRVEDEGNYTCQFVTFPQRSRSVDIWLRVLGGGGSGGGGSEPKSSDKTHTCPPCPAPEAEGAPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1269 - protein, 323 aa, synthetic construct
  REGION 1..323: note = CD155 v143 ECD
WPPPGTGDVVVQAPTQVSGFLGDSVTLPCYLQVPNMEVTHVSQLTWARHGESGSMAVFHQTQGPWYAESKRLEFVAARLGAELRNASLRMFGLRVEDEGNYTCQFVTFPQRSRSVDIWLRVLAKPQNTAEVQKVQLTGEPVPMARCVSTGGRPPAQITWHSDLGGMPNTSQVPGFLSGTVTVTSLWILVPSSQVDGKNVTCKVEHESFEKPQLLTVNLTVYYPPEVSISGYDNNWYLGQNEATLTCDARSNPEPTGYNWSTTMGPLPPFAVAQGAQLLIRPVDKPINTTLICNVTNALGARQAELTVQVKEGPPSEHSGISRN

SEQ ID NO: 1270 - protein, 116 aa, synthetic construct
  REGION 1..116: note = CD155 v143 IgV
PGTGDVVVQAPTQVSGFLGDSVTLPCYLQVPNMEVTHVSQLTWARHGESGSMAVFHQTQGPWYAESKRLEFVAARLGAELRNASLRMFGLRVEDEGNYTCQFVTFPQRSRSVDIWL

SEQ ID NO: 1271 - protein, 122 aa, synthetic construct
  REGION 1..122: note = CD155 v143 IgV
WPPPGTGDVVVQAPTQVSGFLGDSVTLPCYLQVPNMEVTHVSQLTWARHGESGSMAVFHQTQGPWYAESKRLEFVAARLGAELRNASLRMFGLRVEDEGNYTCQFVTFPQRSRSVDIWLRVL

SEQ ID NO: 1272 - protein, 125 aa, Homo sapiens [sequence omitted]

SEQ ID NO: 1273 - protein, 329 aa, synthetic construct
  REGION 1..329: note = CD112 v1 ECD
QDVRVQVLPEVRGQLGGTVELPCHLLPPVPGLHISLVTWQRPDAPANHQNVAAFHPKMGPSFPSPKPGSERLSFVSAKQSTGQDTEAELQDATLALHGLTVEDEGNYTCEFVTFPKDSVRGMTWLRVIAKPKNQAEAQKVTFSQDPTTVALCISKEGRPPARISWLSSLDWEAKETQVSGTLAGTVTVTSRFTLVPSGRADGVTVTCKVEHESFEEPALIPVTLSVRYPPEVSISGYDDNWYLGRTDATLSCDVRSNPEPTGYDWSTTSGTFPTSAVAQGSQLVIHAVDSLFNTTFVCTVTNAVGMGRAEQVIFVRETPNTAGAGATGG

SEQ ID NO: 1274 - protein, 329 aa, synthetic construct
  REGION 1..329: note = CD112 v2 ECD
QDVRVQVLPEVRGQLGGTAELPCHLLPPVPGLHISLVTWQRPDAPANHQNVAAFHPKMGPSFPGPKPGSERLSFVSAKQGTGQDTEAELQDATLALHSLTVEDEGYYTCEFVTFPKGSVRGMTWLRVIAKPKNQAEAQKVTFSQDPTTVALCISKEGRPPARISWLSSLDWEAKETQVSGTLAGTVTVTSRFTLVPSGRADGVTVTCKVEHESFEEPALIPVTLSVRYPPEVSISGYDDNWYLGRTDATLSCDVRSNPEPTGYDWSTTSGTFPTSAVAQGSQLVIHAVDSLFNTTFVCTVTNAVGMGRAEQVIFVRETPNTAGAGATGG

SEQ ID NO: 1275 - protein, 329 aa, synthetic construct
  REGION 1..329: note = CD112 v3 ECD
QDVRVQVLPEVRGQLGGTVELPCHLLPPVPGPYISLVTWQRPDAPANHQNVAAFHPKMGPSFPSPKPGSERLSFVSAKQSTGQDTEAELQDATLALHGLTVEDEGNYTCEFVTFPKGSVRGMTWLRVIAKPKNQAEAQKVTFSQDPTTVALCISKEGRPPARISWLSSLDWEAKETQVSGTLAGTVTVTSRFTLVPSGRADGVTVTCKVEHESFEEPALIPVTLSVRYPPEVSISGYDDNWYLGRTDATLSCDVRSNPEPTGYDWSTTSGTFPTSAVAQGSQLVIHAVDSLFNTTFVCTVTNAVGMGRAEQVIFVRETPNTAGAGATGG

SEQ ID NO: 1276 - protein, 329 aa, synthetic construct
  REGION 1..329: note = CD112 v4 ECD
QDVRVQVLPEVRGQLGGTVELPCHLLPPVPGLYISLVTWQRPDAPANHQNVAAFHPKMGPSFPSPKPGSERLSFVSAKQSTGQDTEAELQDATLVLHGLTVEDEGNYTCEFITFPKGSVRGMTWLRVIAKPKNQAEAQKVTFSQDPTTVALCISKEGRPPARISWLSSLDWEAKETQVSGTLAGTVTVTSRFTLVPSGRADGVTVTCKVEHESFEEPALIPVTLSVRYPPEVSISGYDDNWYLGRTDATLSCDVRSNPEPTGYDWSTTSGTFPTSAVAQGSQLVIHAVDSLFNTTFVCTVTNAVGMGRAEQVIFVRETPNTAGAGATGG

SEQ ID NO: 1277 - protein, 329 aa, synthetic construct
  REGION 1..329: note = CD112 v5 ECD
QDVRVQVLPEVRGQLGGTVELPCHLLPSVPGLYISLVTWQRPDAPANHQNVAAFHPKMGPSFPSPKPGSERLSFVSAKQSTGQDTEAELQDATLALHGLTVEDEGNYTCEFVTFPKGSVRGMTWLRVIAKPKNQAEAQKVTFSQDPTTVALCISKEGRPPARISWLSSLDWEAKETQVSGTLAGTVTVTSRFTLVPSGRADGVTVTCKVEHESFEEPALIPVTLSVRYPPEVSISGYDDNWYLGRTDATLSCDVRSNPEPTGYDWSTTSGTFPTSAVAQGSQLVIHAVDSLFNTTFVCTVTNAVGMGRAEQVIFVRETPNTAGAGATGG

SEQ ID NO: 1278 - protein, 329 aa, synthetic construct
  REGION 1..329: note = CD112 v6 ECD
QDVRVQVLPEVRGQLGGTVELPCHLLAPVPGLYISLVNWQRPDAPANHQNVAAFHPKMGPSFPSPKPGSERLSFVSAKQSTGQDTEAELQDATLALHGLTAEDEGNYTCEFVTFPKGSVRGMTWLRVIAKPKNQAEAQKVTFSQDPTTVALCISKEGRPPARISWLSSLDWEAKETQVSGTLAGTVTVTSRFTLVPSGRADGVTVTCKVEHESFEEPALIPVTLSVRYPPEVSISGYDDNWYLGRTDATLSCDVRSNPEPTGYDWSTTSGTFPTSAVAQGSQLVIHAVDSLFNTTFVCTVTNAVGMGRAEQVIFVRETPNTAGAGATGG

SEQ ID NO: 1279 - protein, 329 aa, synthetic construct
  REGION 1..329: note = CD112 v7 ECD
QDVRVQVLPEVRGQLGGTVELPCHLLPPVPGLYISLVTWQRPDAPANHQNVAAFHPKMGPSFPSPKPGSERLSFVSAKQSTGQDTEAELQDATLALHGLTVEDEGNYTCEFATFPKGFVRGMTWLRVIAKPKNQAEAQKVTFSQDPTTVALCISKEGRPPARISWLSSLDWEAKETQVSGTLAGTVTVTSRFTLVPSGRADGVTVTCKVEHESFEEPALIPVTLSVRYPPEVSISGYDDNWYLGRTDATLSCDVRSNPEPTGYDWSTTSGTFPTSAVAQGSQLVIHAVDSLFNTTFVCTVTNAVGMGRAEQVIFVRETPNTAGAGATGG

SEQ ID NO: 1280 - protein, 329 aa, synthetic construct
  REGION 1..329: note = CD112 v8 ECD
QDVRVQVLPEVWGQLGGTVELPCHLLPPVPGLYISLVTWQRPDAPANYQNVAASHPKMGPSFPSPKPGSERLSFVSAKQSTGQDTEAELQDATLALHGLTVEDEGNYTCEFATFPKGFVRGMTWLRVIAKPKNQAEAQKVTFSQDPTTVALCISKEGRPPARISWLSSLDWEAKETQVSGTLAGTVTVTSRFTLVPSGRADGVTVTCKVEHESFEEPALIPVTLSVRYPPEVSISGYDDNWYLGRTDATLSCDVRSNPEPTGYDWSTTSGTFPTSAVAQGSQLVIHAVDSLFNTTFVCTVTNAVGMGRAEQVIFVRETPNTAGAGATGG

SEQ ID NO: 1281 - protein, 329 aa, synthetic construct
  REGION 1..329: note = CD112 v9 ECD
QDVRVQVLPEVWGQLGGTVELPCHLLPPVPGLYISLVTWQRPDAPANHQNVAAFHPKMGPSFPSPKPGSERLSFVSAKRSTGQDTEAELQDATLALHGLTVEDEGNYTCEFATFPKGFVRGMTWLRVIAKPKNQAEAQKVTFSQDPTTVALCISKEGRPPARISWLSSLDWEAKETQVSGTLAGTVTVTSRFTLVPSGRADGVTVTCKVEHESFEEPALIPVTLSVRYPPEVSISGYDDNWYLGRTDATLSCDVRSNPEPTGYDWSTTSGTFPTSAVAQGSQLVIHAVDSLFNTTFVCTVTNAVGMGRAEQVIFVRETPNTAGAGATGG

SEQ ID NO: 1282 - protein, 329 aa, synthetic construct
  REGION 1..329: note = CD112 v10 ECD
QDVRVQVLPEVRGQLGGTVELPCHLLPPVPGLYISLVTWQRPDAPANHQNVAAFHPKMGPSFPSPKPGSERLSFVSAKQSTGQDTEAELQDATLALHGLTVEDEGNYTCEFASFPKGYVRGMTWLRVIAKPKNQAEAQKVTFSQDPTTVALCISKEGRPPARISWLSSLDWEAKETQVSGTLAGTVTVTSRFTLVPSGRADGVTVTCKVEHESFEEPALIPVTLSVRYPPEVSISGYDDNWYLGRTDATLSCDVRSNPEPTGYDWSTTSGTFPTSAVAQGSQLVIHAVDSLFNTTFVCTVTNAVGMGRAEQVIFVRETPNTAGAGATGG

SEQ ID NO: 1283 - protein, 329 aa, synthetic construct
  REGION 1..329: note = CD112 v11 ECD
QDVRVQVLPEVRGQLGGTVELPCHLLPPVPGLYISLVTWQRPDAPANHQNVAAFHPKMGPSFPSPKPGSERLSFVSAKQSTGQDTEAELQDATLALHGLTVEDEGNYTCEFATFPKGYVRGMTWLRVIAKPKNQAEAQKVTFSQDPTTVALCISKEGRPPARISWLSSLDWEAKETQVSGTLAGTVTVTSRFTLVPSGRADGVTVTCKVEHESFEEPALIPVTLSVRYPPEVSISGYDDNWYLGRTDATLSCDVRSNPEPTGYDWSTTSGTFPTSAVAQGSQLVIHAVDSLFNTTFVCTVTNAVGMGRAEQVIFVRETPNTAGAGATGG

SEQ ID NO: 1284 - protein, 329 aa, synthetic construct
  REGION 1..329: note = CD112 v12 ECD
QDVRVQVLPEVRGQLGGTVELPCHLLPPVPGLYISLVTWQRPDAPANHQNVAAFHPKMGPSFPSPKPGSERLSFVSAKQSTGQDTEAELQDATLALHGLTVEDEGIYTCEFATFPKGYVRGMTWLRVIAKPKNQAEAQKVTFSQDPTTVALCISKEGRPPARISWLSSLDWEAKETQVSGTLAGTVTVTSRFTLVPSGRADGVTVTCKVEHESFEEPALIPVTLSVRYPPEVSISGYDDNWYLGRTDATLSCDVRSNPEPTGYDWSTTSGTFPTSAVAQGSQLVIHAVDSLFNTTFVCTVTNAVGMGRAEQVIFVRETPNTAGAGATGG

SEQ ID NO: 1285 - protein, 329 aa, synthetic construct
  REGION 1..329: note = CD112 v13 ECD
QDVRVQVLPEVRGQLGGTVELPCHLLPPVPGLYISLVTWQRPDAPANHQNVAAFHPKMGPSFPSPKPGSERLSFVSAKQSTGQDTEAELQDATLALHGLTVEDEGIYTCEFATFPKGFVRGMTWLRVIAKPKNQAEAQKVTFSQDPTTVALCISKEGRPPARISWLSSLDWEAKETQVSGTLAGTVTVTSRFTLVPSGRADGVTVTCKVEHESFEEPALIPVTLSVRYPPEVSISGYDDNWYLGRTDATLSCDVRSNPEPTGYDWSTTSGTFPTSAVAQGSQLVIHAVDSLFNTTFVCTVTNAVGMGRAEQVIFVRETPNTAGAGATGG

SEQ ID NO: 1286 - protein, 329 aa, synthetic construct
  REGION 1..329: note = CD112 v14 ECD
QDVRVQVLPEVRGQLGGTVELPCHLLPPVPGLYISLVTWQRPDAPANHQNVAAFHPKMGPSFPSPKPGSERLSFVSAKQSTGQDTEAELQDATLTPHGLTVEDEGNYTCEFATFPKGYVRGMTWLRVIAKPKNQAEAQKVTFSQDPTTVALCISKEGRPPARISWLSSLDWEAKETQVSGTLAGTVTVTSRFTLVPSGRADGVTVTCKVEHESFEEPALIPVTLSVRYPPEVSISGYDDNWYLGRTDATLSCDVRSNPEPTGYDWSTTSGTFPTSAVAQGSQLVIHAVDSLFNTTFVCTVTNAVGMGRAEQVIFVRETPNTAGAGATGG

SEQ ID NO: 1287 - protein, 329 aa, synthetic construct
  REGION 1..329: note = CD112 v15 ECD
QDVRVQVLPEVRGQLGGTVELPCHLLPPVPGLHISLVTWQRPDAPANHQNVAAFHPKMGPSFPSPKSGSERLSFVSAKQSTGQDTEAELQDATLALHGLTVEDEGYYTCEFVTFPKGSVRGMTWLRVIAKPKNQAEAQKVTFSQDPTTVALCISKEGRPPARISWLSSLDWEAKETQVSGTLAGTVTVTSRFTLVPSGRADGVTVTCKVEHESFEEPALIPVTLSVRYPPEVSISGYDDNWYLGRTDATLSCDVRSNPEPTGYDWSTTSGTFPTSAVAQGSQLVIHAVDSLFNTTFVCTVTNAVGMGRAEQVIFVRETPNTAGAGATGG

SEQ ID NO: 1288 - protein, 329 aa, synthetic construct
  REGION 1..329: note = CD112 v16 ECD
QDVRVQVLPEVRGQLGGTVELPCHLLPPVPGLYISLVTWQRPDAPANHQNVAAFHPKMGPSFPSPKPGSERLSFVSAKQSTGQDTEAELQDATLALHGLTVEDEGYYTCEFVTFPKGSVRGMTWLRVIAKPKNQAEAQKVTFSQDPTTVALCISKEGRPPARISWLSSLDWEAKETQVSGTLAGTVTVTSRFTLVPSGRADGVTVTCKVEHESFEEPALIPVTLSVRYPPEVSISGYDDNWYLGRTDATLSCDVRSNPEPTGYDWSTTSGTFPTSAVAQGSQLVIHAVDSLFNTTFVCTVTNAVGMGRAEQVIFVRETPNTAGAGATGG

SEQ ID NO: 1289 - protein, 329 aa, synthetic construct
  REGION 1..329: note = CD112 v17 ECD
QDVRVQVLPEVRGQLGGSVELPCHLLPPVPGLHISLVTWQRPDAPANHQNVAAFHPKMGPSFPSPKPGSERLSFVSAKQSTGQDTEAELQDATLALHGLTVEDEGNYTCEFVTFPKGSVRGMTWLRVIAKPKNQAEAQKVTFSQDPTTVALCISKEGRPPARISWLSSLDWEAKETQVSGTLAGTVTVTSRFTLVPSGRADGVTVTCKVEHESFEEPALIPVTLSVRYPPEVSISGYDDNWYLGRTDATLSCDVRSNPEPTGYDWSTTSGTFPTSAVAQGSQLVIHAVDSLFNTTFVCTVTNAVGMGRAEQVIFVRETPNTAGAGATGG

SEQ ID NO: 1290 - protein, 329 aa, synthetic construct
  REGION 1..329: note = CD112 v18 ECD
QDVRVQVLSEVRGQLGGTVELPCHLLPPVPGLHISLVTWQRPDAPASHQNVAAFHPKMGPSFPSPKPGSERLSFVSAKQSTGQDTEAELQDATLALHGLTVEDEGNYTCEFVTFPKGSVRGMTWLRVIAKPKNQAEAQKVTFSQDPTTVALCISKEGRPPARISWLSSLDWEAKETQVSGTLAGTVTVTSRFTLVPSGRADGVTVTCKVEHESFEEPALIPVTLSVRYPPEVSISGYDDNWYLGRTDATLSCDVRSNPEPTGYDWSTTSGTFPTSAVAQGSQLVIHAVDSLFNTTFVCTVTNAVGMGRAEQVIFVRETPNTAGAGATGG

SEQ ID NO: 1291 - protein, 329 aa, synthetic construct
  REGION 1..329: note = CD112 v19 ECD
QDVRVQVLPEVRGQLGGTVELPCHLLPPVPGLYISLVTWQRSDAPANHQNVAAFHPKMGPSFPSPKHGSERLSFVSAKQSTGQDTEAELQDATLALHGLTVEDEGNYTCEFVTFPKGSVRGMTWLRVIAKPKNQAEAQKVTFSQDPTTVALCISKEGRPPARISWLSSLDWEAKETQVSGTLAGTVTVTSRFTLVPSGRADGVTVTCKVEHESFEEPALIPVTLSVRYPPEVSISGYDDNWYLGRTDATLSCDVRSNPEPTGYDWSTTSGTFPTSAVAQGSQLVIHAVDSLFNTTFVCTVTNAVGMGRAEQVIFVRETPNTAGAGATGG

SEQ ID NO: 1292 - protein, 329 aa, synthetic construct
  REGION 1..329: note = CD112 v20 ECD
QDVRVQVLPEVRGQLGGTVELPCHLLLPVPGPYISLVTWQRSDAPANHQNVAAFHPKMGPSFPSPKPGSERLSFVSAKQSTGQDTEAELQDATLALHGLTVEDEGNYTCEFVTFPKGSVRGMTWLRVIAKPKNQAEAQKVTFSQDPTTVALCISKEGRPPARISWLSSLDWEAKETQVSGTLAGTVTVTSRFTLVPSGRADGVTVTCKVEHESFEEPALIPVTLSVRYPPEVSISGYDDNWYLGRTDATLSCDVRSNPEPTGYDWSTTSGTFPTSAVAQGSQLVIHAVDSLFNTTFVCTVTNAVGMGRAEQVIFVRETPNTAGAGATGG

SEQ ID NO: 1293 - protein, 329 aa, synthetic construct
  REGION 1..329: note = CD112 v21 ECD
QDVRVQVLPEVRGQLGGTVELPCHLLPPVPGLYISLVTWQRPDAPANHQNVAAFHPKMGPSFPSPKPGSERLSFVSAKQSTGQDTEAELQDATLALHDLTVEDEGNYTCEFVTFPKGSVRGMTWLRVIAKPKNQAEAQKVTFSQDPTTVALCISKEGRPPARISWLSSLDWEAKETQVSGTLAGTVTVTSRFTLVPSGRADGVTVTCKVEHESFEEPALIPVTLSVRYPPEVSISGYDDNWYLGRTDATLSCDVRSNPEPTGYDWSTTSGTFPTSAVAQGSQLVIHAVDSLFNTTFVCTVTNAVGMGRAEQVIFVRETPNTAGAGATGG

SEQ ID NO: 1294 - protein, 329 aa, synthetic construct
  REGION 1..329: note = CD112 v22 ECD
QDVRVQVLPEVRGQLGGTVELPCHLLPPVPGLHIPLVTWQRPDAPANHQNVAAFHPKMGPSFPSPKPGSERLSFVSAKQSTGQDTEAELQDATLALHGLTVEDEGYYTCEFVTFPKGSVRGMTWLRVIAKPKNQAEAQKVTFSQDPTTVALCISKEGRPPARISWLSSLDWEAKETQVSGTLAGTVTVTSRFTLVPSGRADGVTVTCKVEHESFEEPALIPVTLSVRYPPEVSISGYDDNWYLGRTDATLSCDVRSNPEPTGYDWSTTSGTFPTSAVAQGSQLVIHAVDSLFNTTFVCTVTNAVGMGRAEQVIFVRETPNTAGAGATGG

SEQ ID NO: 1295 - protein, 329 aa, synthetic construct
  REGION 1..329: note = CD112 v23 ECD
QDVRVQVLPEVRGQLGGTVELPCHLLPPVPGPYISLVTWQRSDAPANHQNVAAFHPKMGPSFPSPKPGSERLSFVSAKQSTGQDTEAELQDATLALHGLAVEDEGNYTCEFVTFPKGSVRGMTWLRVIAKPKNQAEAQKVTFSQDPTTVALCISKEGRPPARISWLSSLDWEAKETQVSGTLAGTVTVTSRFTLVPSGRADGVTVTCKVEHESFEEPALIPVTLSVRYPPEVSISGYDDNWYLGRTDATLSCDVRSNPEPTGYDWSTTSGTFPTSAVAQGSQLVIHAVDSLFNTTFVCTVTNAVGMGRAEQVIFVRETPNTAGAGATGG

SEQ ID NO: 1296 - protein, 329 aa, synthetic construct
  REGION 1..329: note = CD112 v24 ECD
QDVRVQVLPEVRGQLGGTVELPCHLLSPVPGLYISLVTWQRPDASANHQNVAAFHPKMGPSFPSPKPGSERLSFVSAKQSTGQDTEAELQDATLALHGLTVEDEGIYTCEFVTFPKGSVRGMTWLRVIAKPKNQAEAQKVTFSQDPTTVALCISKEGRPPARISWLSSLDWEAKETQVSGTLAGTVTVTSRFTLVPSGRADGVTVTCKVEHESFEEPALIPVTLSVRYPPEVSISGYDDNWYLGRTDATLSCDVRSNPEPTGYDWSTTSGTFPTSAVAQGSQLVIHAVDSLFNTTFVCTVTNAVGMGRAEQVIFVRETPNTAGAGATGG

SEQ ID NO: 1297 - protein, 329 aa, synthetic construct
  REGION 1..329: note = CD112 v25 ECD
QDVRVQVLPEVRGQLGGTVELPCHLLPPVPGLHISLVTWQRPDAPAKHQNVAAFHPKMGPSFPSPKPGSERLSFVSAKQSTGQDTEAELQDATLALHGLTVEDEGNYTCEFVTFPKGSVRGMTWLRVIAKPKNQAEAQKVTFSQDPTTVALCISKEGRPPARISWLSSLDWEAKETQVSGTLAGTVTVTSRFTLVPSGRADGVTVTCKVEHESFEEPALIPVTLSVRYPPEVSISGYDDNWYLGRTDATLSCDVRSNPEPTGYDWSTTSGTFPTSAVAQGSQLVIHAVDSLFNTTFVCTVTNAVGMGRAEQVIFVRETPNTAGAGATGG

SEQ ID NO: 1298 - protein, 329 aa, synthetic construct
  REGION 1..329: note = CD112 v26 ECD
QDVRVQVLPEVRGQLGGTVELPCHLLPPVPGLHISLVTWQRPDAPANHQNVAAFHPKMGPSFPSPKPGSERLSFVSAKQSTGQDTEAELQDATLALHGLTVEDEGYYTCEFVTFPKGSVRGMTWLRVIAKPKNQAEAQKVTFSQDPTTVALCISKEGRPPARISWLSSLDWEAKETQVSGTLAGTVTVTSRFTLVPSGRADGVTVTCKVEHESFEEPALIPVTLSVRYPPEVSISGYDDNWYLGRTDATLSCDVRSNPEPTGYDWSTTSGTFPTSAVAQGSQLVIHAVDSLFNTTFVCTVTNAVGMGRAEQVIFVRETPNTAGAGATGG

SEQ ID NO: 1299 - protein, 329 aa, synthetic construct
  REGION 1..329: note = CD112 v27 ECD
QDVRVQVLPEVRGQLGGTVELPCHLLPPVPGLYISLVTWQRPDAPANHQNVAAFHPKMGPSFPSPKPGSERLSFVSARQSTGQGTEAELQDATLALHGLTVEDEGNYTCEFVTSPKGSVRGMTWLRVIAKPKNQAEAQKVTFSQDPTTVALCISKEGRPPARISWLSSLDWEAKETQVSGTLAGTVTVTSRFTLVPSGRADGVTVTCKVEHESFEEPALIPVTLSVRYPPEVSISGYDDNWYLGRTDATLSCDVRSNPEPTGYDWSTTSGTFPTSAVAQGSQLVIHAVDSLFNTTFVCTVTNAVGMGRAEQVIFVRETPNTAGAGATGG

SEQ ID NO: 1300 - protein, 329 aa, synthetic construct
  REGION 1..329: note = CD112 v28 ECD
QDVRVQVLPEVRGQLGGTVELPCHLLPPVPGLHISLVTWQRPDAPAKHQNVAALHPKMGPSFPSPKPGSERLSFVSAKQSTGQDTEAELQDATLALHGLTVEDEGNYTCEFVTFPKGSVRGMTWLRVIAKPKNQAEAQKVTFSQDPTTVALCISKEGRPPARISWLSSLDWEAKETQVSGTLAGTVTVTSRFTLVPSGRADGVTVTCKVEHESFEEPALIPVTLSVRYPPEVSISGYDDNWYLGRTDATLSCDVRSNPEPTGYDWSTTSGTFPTSAVAQGSQLVIHAVDSLFNTTFVCTVTNAVGMGRAEQVIFVRETPNTAGAGATGG

SEQ ID NO: 1301 - protein, 329 aa, synthetic construct
  REGION 1..329: note = CD112 v29 ECD
QDVRVQVLPEVRGQLGGTVELPCHLLPPVPGLHISLVTWQRPDAPANHQNVAAFHPKMGPSFPSPKPGSERLSFVSAKQSTGQDTEAELQDATLALHGLTVEDEGNYTCEFVTFPKGSVRGMTWLRVIAKPKNQAEAQKVTFSQDPTTVALCISKEGRPPARISWLSSLDWEAKETQVSGTLAGTVTVTSRFTLVPSGRADGVTVTCKVEHESFEEPALIPVTLSVRYPPEVSISGYDDNWYLGRTDATLSCDVRSNPEPTGYDWSTTSGTFPTSAVAQGSQLVIHAVDSLFNTTFVCTVTNAVGMGRAEQVIFVRETPNTAGAGATGG

SEQ ID NO: 1302 - protein, 329 aa, synthetic construct
  REGION 1..329: note = CD112 v30 ECD
QDVRVQVLPEVRGQLGGTVELPCHLLPPVPGLYISLVTWQRPDAPANHQNVAAFHPKMGPSFPSPKPGSERLSFVSAKQSTGQDTEAELQDATLVLHGLTVEDEGNYTCEFVTFPKGSVRGMTWLRVIAKPKNQAEAQKVTFSQDPTTVALCISKEGRPPARISWLSSLDWEAKETQVSGTLAGTVTVTSRFTLVPSGRADGVTVTCKVEHESFEEPALIPVTLSVRYPPEVSISGYDDNWYLGRTDATLSCDVRSNPEPTGYDWSTTSGTFPTSAVAQGSQLVIHAVDSLFNTTFVCTVTNAVGMGRAEQVIFVRETPNTAGAGATGG

SEQ ID NO: 1303 - protein, 329 aa, synthetic construct
  REGION 1..329: note = CD112 v31 ECD
QDVRVQVLPEVWGQLGGTVELPCHLLPPVPGLYISLVTWQRPDAPANHQNVAAFHPKMGPSFPSPKPGSERLSFVSAKQSTGQDTEAELQDATLALHGLTVEDEGNYTCEFVTFPKGSVRGMTWLRVIAKPKNQAEAQKVTFSQDPTTVALCISKEGRPPARISWLSSLDWEAKETQVSGTLAGTVTVTSRFTLVPSGRADGVTVTCKVEHESFEEPALIPVTLSVRYPPEVSISGYDDNWYLGRTDATLSCDVRSNPEPTGYDWSTTSGTFPTSAVAQGSQLVIHAVDSLFNTTFVCTVTNAVGMGRAEQVIFVRETPNTAGAGATGG

SEQ ID NO: 1304 - protein, 329 aa, synthetic construct
  REGION 1..329: note = CD112 v32 ECD
QDVRVQVLPEVWGQLGGTVELPCHLLSPVPGLYISLVTWQRPDAPANHQNVAAFHPKMGPSFPSPKPGSERLSFVSAKQSTGQDTEAELQDATLALHGLTVEDEGNYTCEFVTFPKGSVRGMTWLRVIAKPKNQAEAQKVTFSQDPTTVALCISKEGRPPARISWLSSLDWEAKETQVSGTLAGTVTVTSRFTLVPSGRADGVTVTCKVEHESFEEPALIPVTLSVRYPPEVSISGYDDNWYLGRTDATLSCDVRSNPEPTGYDWSTTSGTFPTSAVAQGSQLVIHAVDSLFNTTFVCTVTNAVGMGRAEQVIFVRETPNTAGAGATGG

SEQ ID NO: 1305 - protein, 329 aa, synthetic construct
  REGION 1..329: note = CD112 v33 ECD
QDVRVQVLPEVRGQLGGTVELPCHLLPPVPGLHISLVTWQRPDAPANHQNMAAFHPKMGPSFPSPKPGSERLSFVSAKQSTGQDTEAELQDATLALHGLTVEDEGNYTCEFVTFPKGSVRGMTWLRVIAKPKNQAEAQKVTFSQDPTTVALCISKEGRPPARISWLSSLDWEAKETQVSGTLAGTVTVTSRFTLVPSGRADGVTVTCKVEHESFEEPALIPVTLSVRYPPEVSISGYDDNWYLGRTDATLSCDVRSNPEPTGYDWSTTSGTFPTSAVAQGSQLVIHAVDSLFNTTFVCTVTNAVGMGRAEQVIFVRETPNTAGAGATGG

SEQ ID NO: 1306 - protein, 329 aa, synthetic construct
  REGION 1..329: note = CD112 v34 ECD
QDVRVQVLPEVRGQLGGTVELPCHLLPPVPGLHISLVTWQRPDAPANHQNVAAFHPKMGPSFPSPKPGSERLSFVSAKQSTGQDTEAELQDATLALHGLTVEDEGNYTCEFVTFPKGTVRGMTWLRVIAKPKNQAEAQKVTFSQDPTTVALCISKEGRPPARISWLSSLDWEAKETQVSGTLAGTVTVTSRFTLVPSGRADGVTVTCKVEHESFEEPALIPVTLSVRYPPEVSISGYDDNWYLGRTDATLSCDVRSNPEPTGYDWSTTSGTFPTSAVAQGSQLVIHAVDSLFNTTFVCTVTNAVGMGRAEQVIFVRETPNTAGAGATGG

SEQ ID NO: 1307 - protein, 329 aa, synthetic construct
  REGION 1..329: note = CD112 v35 ECD
QDVRVQVLPEVRGQLGGTVELPCHLLPPVPGLHISLVTWQRPDAPANHQNVAAFHPKMGPSFPSPKPGSERLSFVSAKQSTGQDTEAELQDATLALHGLTAEDEGNYTCEFVTFSKGSVRGMTWLRVIAKPKNQAEAQKVTFSQDPTTVALCISKEGRPPARISWLSSLDWEAKETQVSGTLAGTVTVTSRFTLVPSGRADGVTVTCKVEHESFEEPALIPVTLSVRYPPEVSISGYDDNWYLGRTDATLSCDVRSNPEPTGYDWSTTSGTFPTSAVAQGSQLVIHAVDSLFNTTFVCTVTNAVGMGRAEQVIFVRETPNTAGAGATGG

SEQ ID NO: 1308 - protein, 329 aa, synthetic construct
  REGION 1..329: note = CD112 v36 ECD
QDVRVQVLPEVRGQLGGTVELPCRLLPPVPGLYISLVNWQRPGAPANHQNVAAFHPKMGPSFPSPKPGSERLSFVSAKQSTGQDTEAELQDATLALHGLTVEDEGNYTCEFVTFPKGSVRGMTWLRVIAKPKNQAEAQKVTFSQDPTTVALCISKEGRPPARISWLSSLDWEAKETQVSGTLAGTVTVTSRFTLVPSGRADGVTVTCKVEHESFEEPALIPVTLSVRYPPEVSISGYDDNWYLGRTDATLSCDVRSNPEPTGYDWSTTSGTFPTSAVAQGSQLVIHAVDSLFNTTFVCTVTNAVGMGRAEQVIFVRETPNTAGAGATGG

SEQ ID NO: 1309 - protein, 329 aa, synthetic construct
  REGION 1..329: note = CD112 v37 ECD
QDVRVQVLPEVRGQLGGTVELPCHLLPPVPGLYISLVTWQRPDAPANHQNVAAFHPKMGPSFPSPKPGSERLSFVSAKQSTGQDTEAELQDATLALHGLTVEDEGNYTCEFVTFPKGSVRGMTWLRVIAKPKNQAEAQKVTFSQDPTTVALCISKEGRPPARISWLSSLDWEAKETQVSGTLAGTVTVTSRFTLVPSGRADGVTVTCKVEHESFEEPALIPVTLSVRYPPEVSISGYDDNWYLGRTDATLSCDVRSNPEPTGYDWSTTSGTFPTSAVAQGSQLVIHAVDSLFNTTFVCTVTNAVGMGRAEQVIFVRETPNTAGAGATGG

SEQ ID NO: 1310 - protein, 329 aa, synthetic construct
  REGION 1..329: note = CD112 v38 ECD
QDVRVQVLPEVRGQLGGTVELPCHLLAPVPGLYISLVTWQRPDAPANHQNVAAFHPKMGPSFPSPKPGSERLSFVSAKQSTGQDTEAELQDATLALHGLTVEDEGNYTCEFVTFPKGSVRGMTWLRVIAKPKNQAEAQKVTFSQDPTTVALCISKEGRPPARISWLSSLDWEAKETQVSGTLAGTVTVTSRFTLVPSGRADGVTVTCKVEHESFEEPALIPVTLSVRYPPEVSISGYDDNWYLGRTDATLSCDVRSNPEPTGYDWSTTSGTFPTSAVAQGSQLVIHAVDSLFNTTFVCTVTNAVGMGRAEQVIFVRETPNTAGAGATGG

SEQ ID NO: 1311 - protein, 329 aa, synthetic construct
  REGION 1..329: note = CD112 v39 ECD
QDVRVQVLPEVRGQLGGTVELPCHLLPPVPGLYISLVTWQRPDAPANHQNVAAFHPKMGPSFPSPKPGSERLSFVSAKQSTGQDTEAELQDATLALHGLTVEDEGNYTCEFVTFPKGTVRGMTWLRVIAKPKNQAEAQKVTFSQDPTTVALCISKEGRPPARISWLSSLDWEAKETQVSGTLAGTVTVTSRFTLVPSGRADGVTVTCKVEHESFEEPALIPVTLSVRYPPEVSISGYDDNWYLGRTDATLSCDVRSNPEPTGYDWSTTSGTFPTSAVAQGSQLVIHAVDSLFNTTFVCTVTNAVGMGRAEQVIFVRETPNTAGAGATGG

SEQ ID NO: 1312 - protein, 329 aa, synthetic construct
  REGION 1..329: note = CD112 v40 ECD
QDVRVQVLPEVWGQLGGTVELPCHLLPPVPGLYISLVTWQRPDAPANHQNVAAFHPKMGPSFPSPKPGSERLSFVSAKQSTGQDTEAELQDATLALHGLTVEDEGNYTCEFVTFPKGSVRGITWLRVIAKPKNQAEAQKVTFSQDPTTVALCISKEGRPPARISWLSSLDWEAKETQVSGTLAGTVTVTSRFTLVPSGRADGVTVTCKVEHESFEEPALIPVTLSVRYPPEVSISGYDDNWYLGRTDATLSCDVRSNPEPTGYDWSTTSGTFPTSAVAQGSQLVIHAVDSLFNTTFVCTVTNAVGMGRAEQVIFVRETPNTAGAGATGG

SEQ ID NO: 1313 - protein, 329 aa, synthetic construct
  REGION 1..329: note = CD112 v41 ECD
QDVRVQVLPEVRGQLGGTVELPCHLLPPVPGLYISLVTWQRPDAPANHQNVAAFHPKMGPSFPSPKPGSERLSFVSAKQSTGKDTEAELQDATLALHGLTVEDEGYYTCEFVTFPKGSVRGMTWLRVIAKPKNQAEAQKVTFSQDPTTVALCISKEGRPPARISWLSSLDWEAKETQVSGTLAGTVTVTSRFTLVPSGRADGVTVTCKVEHESFEEPALIPVTLSVRYPPEVSISGYDDNWYLGRTDATLSCDVRSNPEPTGYDWSTTSGTFPTSAVAQGSQLVIHAVDSLFNTTFVCTVTNAVGMGRAEQVIFVRETPNTAGAGATGG

SEQ ID NO: 1314 - protein, 329 aa, synthetic construct
  REGION 1..329: note = CD112 v42 ECD
QDVRVQVLPEVWGQLGGTVELPCHLLSPVPGLYISLVTWQRPDAPANHQNVAAFHPKMGPSFPSPKPGSERLSFVSAKQSTGQDTEAELQDATLALHGLTVEDEGNYTCEFVTFPKGTVRGMTWLRVIAKPKNQAEAQKVTFSQDPTTVALCISKEGRPPARISWLSSLDWEAKETQVSGTLAGTVTVTSRFTLVPSGRADGVTVTCKVEHESFEEPALIPVTLSVRYPPEVSISGYDDNWYLGRTDATLSCDVRSNPEPTGYDWSTTSGTFPTSAVAQGSQLVIHAVDSLFNTTFVCTVTNAVGMGRAEQVIFVRETPNTAGAGATGG

SEQ ID NO: 1315 - protein, 329 aa, synthetic construct
  REGION 1..329: note = CD112 v43 ECD
QDVRVQVLPEVRGQLGGTVELPCHLLPSVPGLHISLVTWQRPDAPANHQNVAAFHPKMGPSFPSPKPGSERLSFVSAKQSTGQDTEAELQDATLALHGLTVEDEGNYTCEFVTFPKGSVRGMTWLRVIAKPKNQAEAQKVTFSQDPTTVALCISKEGRPPARISWLSSLDWEAKETQVSGTLAGTVTVTSRFTLVPSGRADGVTVTCKVEHESFEEPALIPVTLSVRYPPEVSISGYDDNWYLGRTDATLSCDVRSNPEPTGYDWSTTSGTFPTSAVAQGSQLVIHAVDSLFNTTFVCTVTNAVGMGRAEQVIFVRETPNTAGAGATGG

SEQ ID NO: 1316 - protein, 329 aa, synthetic construct
  REGION 1..329: note = CD112 v44 ECD
QDVRVQVLPEVRGQLGGTVELPCHLLSPVPGLYISLVTWQRPDAPANHQNVAAFHPKMGPSFPSPKPGSERLSFVSAKQSTGQDTEAELRDATLALHGLTVEDEGNYTCEFVTFPKGSVRGMTWLRVIAKPKNQAEAQKVTFSQDPTTVALCISKEGRPPARISWLSSLDWEAKETQVSGTLAGTVTVTSRFTLVPSGRADGVTVTCKVEHESFEEPALIPVTLSVRYPPEVSISGYDDNWYLGRTDATLSCDVRSNPEPTGYDWSTTSGTFPTSAVAQGSQLVIHAVDSLFNTTFVCTVTNAVGMGRAEQVIFVRETPNTAGAGATGG

SEQ ID NO: 1317 - protein, 329 aa, synthetic construct
  REGION 1..329: note = CD112 v45 ECD
QDVRVQVLPEVRGQVGGTVELPCHLLAPVPGLYISLVTWQRPDAPANHQNVAAFHPKMGPSFPSPKPGSERLSFVSAKQSTGQDTEAELQDATLALHGLTVEDEGNYTCEFVTFPKGTVRGMTWLRVIAKPKNQAEAQKVTFSQDPTTVALCISKEGRPPARISWLSSLDWEAKETQVSGTLAGTVTVTSRFTLVPSGRADGVTVTCKVEHESFEEPALIPVTLSVRYPPEVSISGYDDNWYLGRTDATLSCDVRSNPEPTGYDWSTTSGTFPTSAVAQGSQLVIHAVDSLFNTTFVCTVTNAVGMGRAEQVIFVRETPNTAGAGATGG

SEQ ID NO: 1318 - protein, 329 aa, synthetic construct
  REGION 1..329: note = CD112 v46 ECD
QDVRVQVLPEVRGQLGGTVELPCHLLPPVPGLHISLVTWQRPDAPANHQNVAAFHPKMGPSFPSPKPGSERLSFVSAKQSTGQDTEAELQDATLALHGLTVEDEGYYICEFVTFPKGSVRGMTWLRVIAKPKNQAEAQKVTFSQDPTTVALCISKEGRPPARISWLSSLDWEAKETQVSGTLAGTVTVTSRFTLVPSGRADGVTVTCKVEHESFEEPALIPVTLSVRYPPEVSISGYDDNWYLGRTDATLSCDVRSNPEPTGYDWSTTSGTFPTSAVAQGSQLVIHAVDSLFNTTFVCTVTNAVGMGRAEQVIFVRETPNTAGAGATGG

SEQ ID NO: 1319 - protein, 329 aa, synthetic construct
  REGION 1..329: note = CD112 v47 ECD
QDVRVQVLPEVRGQLGGTVELPCHLLPPVPGLHISLVTWQRPDAPANHQNVAAFHLKMGPSFPSPKPGSERLSFMSAKQSTGQDTEAELQDATLALHGLTMEDEGNYTCEFVTFPKGSVRGMTWLRVIAKPKNQAEAQKVTFSQDPTTVALCISKEGRPPARISWLSSLDWEAKETQVSGTLAGTVTVTSRFTLVPSGRADGVTVTCKVEHESFEEPALIPVTLSVRYPPEVSISGYDDNWYLGRTDATLSCDVRSNPEPTGYDWSTTSGTFPTSAVAQGSQLVIHAVDSLFNTTFVCTVTNAVGMGRAEQVIFVRETPNTAGAGATGG

SEQ ID NO: 1320 - protein, 125 aa, synthetic construct
  REGION 1..125: note = CD112 v1 IgV
QDVRVQVLPEVRGQLGGTVELPCHLLPPVPGLHISLVTWQRPDAPANHQNVAAFHPKMGPSFPSPKPGSERLSFVSAKQSTGQDTEAELQDATLALHGLTVEDEGNYTCEFVTFPKDSVRGMTWL

SEQ ID NO: 1321 - protein, 125 aa, synthetic construct
  REGION 1..125: note = CD112 v2 IgV
QDVRVQVLPEVRGQLGGTAELPCHLLPPVPGLHISLVTWQRPDAPANHQNVAAFHPKMGPSFPGPKPGSERLSFVSAKQGTGQDTEAELQDATLALHSLTVEDEGYYTCEFVTFPKGSVRGMTWL

SEQ ID NO: 1322 - protein, 125 aa, synthetic construct
  REGION 1..125: note = CD112 v3 IgV
QDVRVQVLPEVRGQLGGTVELPCHLLPPVPGPYISLVTWQRPDAPANHQNVAAFHPKMGPSFPSPKPGSERLSFVSAKQSTGQDTEAELQDATLALHGLTVEDEGNYTCEFVTFPKGSVRGMTWL

SEQ ID NO: 1323 - protein, 125 aa, synthetic construct
  REGION 1..125: note = CD112 v4 IgV
QDVRVQVLPEVRGQLGGTVELPCHLLPPVPGLYISLVTWQRPDAPANHQNVAAFHPKMGPSFPSPKPGSERLSFVSAKQSTGQDTEAELQDATLVLHGLTVEDEGNYTCEFITFPKGSVRGMTWL

SEQ ID NO: 1324 - protein, 125 aa, synthetic construct
  REGION 1..125: note = CD112 v5 IgV
QDVRVQVLPEVRGQLGGTVELPCHLLPSVPGLYISLVTWQRPDAPANHQNVAAFHPKMGPSFPSPKPGSERLSFVSAKQSTGQDTEAELQDATLALHGLTVEDEGNYTCEFVTFPKGSVRGMTWL

SEQ ID NO: 1325 - protein, 125 aa, synthetic construct
  REGION 1..125: note = CD112 v6 IgV
QDVRVQVLPEVRGQLGGTVELPCHLLAPVPGLYISLVNWQRPDAPANHQNVAAFHPKMGPSFPSPKPGSERLSFVSAKQSTGQDTEAELQDATLALHGLTAEDEGNYTCEFVTFPKGSVRGMTWL

SEQ ID NO: 1326 - protein, 125 aa, synthetic construct
  REGION 1..125: note = CD112 v7 IgV
QDVRVQVLPEVRGQLGGTVELPCHLLPPVPGLYISLVTWQRPDAPANHQNVAAFHPKMGPSFPSPKPGSERLSFVSAKQSTGQDTEAELQDATLALHGLTVEDEGNYTCEFATFPKGFVRGMTWL

SEQ ID NO: 1327 - protein, 125 aa, synthetic construct
  REGION 1..125: note = CD112 v8 IgV
QDVRVQVLPEVWGQLGGTVELPCHLLPPVPGLYISLVTWQRPDAPANYQNVAASHPKMGPSFPSPKPGSERLSFVSAKQSTGQDTEAELQDATLALHGLTVEDEGNYTCEFATFPKGFVRGMTWL

SEQ ID NO: 1328 - protein, 125 aa, synthetic construct
  REGION 1..125: note = CD112 v9 IgV
QDVRVQVLPEVWGQLGGTVELPCHLLPPVPGLYISLVTWQRPDAPANHQNVAAFHPKMGPSFPSPKPGSERLSFVSAKRSTGQDTEAELQDATLALHGLTVEDEGNYTCEFATFPKGFVRGMTWL

SEQ ID NO: 1329 - protein, 125 aa, synthetic construct
  REGION 1..125: note = CD112 v10 IgV
QDVRVQVLPEVRGQLGGTVELPCHLLPPVPGLYISLVTWQRPDAPANHQNVAAFHPKMGPSFPSPKPGSERLSFVSAKQSTGQDTEAELQDATLALHGLTVEDEGNYTCEFASFPKGYVRGMTWL

SEQ ID NO: 1330 - protein, 125 aa, synthetic construct
  REGION 1..125: note = CD112 v11 IgV
QDVRVQVLPEVRGQLGGTVELPCHLLPPVPGLYISLVTWQRPDAPANHQNVAAFHPKMGPSFPSPKPGSERLSFVSAKQSTGQDTEAELQDATLALHGLTVEDEGNYTCEFATFPKGYVRGMTWL

SEQ ID NO: 1331 - protein, 125 aa, synthetic construct
  REGION 1..125: note = CD112 v12 IgV
QDVRVQVLPEVRGQLGGTVELPCHLLPPVPGLYISLVTWQRPDAPANHQNVAAFHPKMGPSFPSPKPGSERLSFVSAKQSTGQDTEAELQDATLALHGLTVEDEGIYTCEFATFPKGYVRGMTWL

SEQ ID NO: 1332 - protein, 125 aa, synthetic construct
  REGION 1..125: note = CD112 v13 IgV
QDVRVQVLPEVRGQLGGTVELPCHLLPPVPGLYISLVTWQRPDAPANHQNVAAFHPKMGPSFPSPKPGSERLSFVSAKQSTGQDTEAELQDATLALHGLTVEDEGIYTCEFATFPKGFVRGMTWL

SEQ ID NO: 1333 - protein, 125 aa, synthetic construct
  REGION 1..125: note = CD112 v14 IgV
QDVRVQVLPEVRGQLGGTVELPCHLLPPVPGLYISLVTWQRPDAPANHQNVAAFHPKMGPSFPSPKPGSERLSFVSAKQSTGQDTEAELQDATLTPHGLTVEDEGNYTCEFATFPKGYVRGMTWL

SEQ ID NO: 1334 - protein, 125 aa, synthetic construct
  REGION 1..125: note = CD112 v15 IgV
QDVRVQVLPEVRGQLGGTVELPCHLLPPVPGLHISLVTWQRPDAPANHQNVAAFHPKMGPSFPSPKSGSERLSFVSAKQSTGQDTEAELQDATLALHGLTVEDEGYYTCEFVTFPKGSVRGMTWL

SEQ ID NO: 1335 - protein, 125 aa, synthetic construct
  REGION 1..125: note = CD112 v16 IgV
QDVRVQVLPEVRGQLGGTVELPCHLLPPVPGLYISLVTWQRPDAPANHQNVAAFHPKMGPSFPSPKPGSERLSFVSAKQSTGQDTEAELQDATLALHGLTVEDEGYYTCEFVTFPKGSVRGMTWL

SEQ ID NO: 1336 - protein, 125 aa, synthetic construct
  REGION 1..125: note = CD112 v17 IgV
QDVRVQVLPEVRGQLGGSVELPCHLLPPVPGLHISLVTWQRPDAPANHQNVAAFHPKMGPSFPSPKPGSERLSFVSAKQSTGQDTEAELQDATLALHGLTVEDEGNYTCEFVTFPKGSVRGMTWL

SEQ ID NO: 1337 - protein, 125 aa, synthetic construct
  REGION 1..125: note = CD112 v18 IgV
QDVRVQVLSEVRGQLGGTVELPCHLLPPVPGLHISLVTWQRPDAPASHQNVAAFHPKMGPSFPSPKPGSERLSFVSAKQSTGQDTEAELQDATLALHGLTVEDEGNYTCEFVTFPKGSVRGMTWL

SEQ ID NO: 1338 - protein, 125 aa, synthetic construct
  REGION 1..125: note = CD112 v19 IgV
QDVRVQVLPEVRGQLGGTVELPCHLLPPVPGLYISLVTWQRSDAPANHQNVAAFHPKMGPSFPSPKHGSERLSFVSAKQSTGQDTEAELQDATLALHGLTVEDEGNYTCEFVTFPKGSVRGMTWL

SEQ ID NO: 1339 - protein, 125 aa, synthetic construct
  REGION 1..125: note = CD112 v20 IgV
QDVRVQVLPEVRGQLGGTVELPCHLLLPVPGPYISLVTWQRSDAPANHQNVAAFHPKMGPSFPSPKPGSERLSFVSAKQSTGQDTEAELQDATLALHGLTVEDEGNYTCEFVTFPKGSVRGMTWL

SEQ ID NO: 1340 - protein, 125 aa, synthetic construct
  REGION 1..125: note = CD112 v21 IgV
QDVRVQVLPEVRGQLGGTVELPCHLLPPVPGLYISLVTWQRPDAPANHQNVAAFHPKMGPSFPSPKPGSERLSFVSAKQSTGQDTEAELQDATLALHDLTVEDEGNYTCEFVTFPKGSVRGMTWL

SEQ ID NO: 1341 - protein, 125 aa, synthetic construct
  REGION 1..125: note = CD112 v22 IgV
QDVRVQVLPEVRGQLGGTVELPCHLLPPVPGLHIPLVTWQRPDAPANHQNVAAFHPKMGPSFPSPKPGSERLSFVSAKQSTGQDTEAELQDATLALHGLTVEDEGYYTCEFVTFPKGSVRGMTWL

SEQ ID NO: 1342 - protein, 125 aa, synthetic construct
  REGION 1..125: note = CD112 v23 IgV
QDVRVQVLPEVRGQLGGTVELPCHLLPPVPGPYISLVTWQRSDAPANHQNVAAFHPKMGPSFPSPKPGSERLSFVSAKQSTGQDTEAELQDATLALHGLAVEDEGNYTCEFVTFPKGSVRGMTWL

SEQ ID NO: 1343 - protein, 125 aa, synthetic construct
  REGION 1..125: note = CD112 v24 IgV
QDVRVQVLPEVRGQLGGTVELPCHLLSPVPGLYISLVTWQRPDASANHQNVAAFHPKMGPSFPSPKPGSERLSFVSAKQSTGQDTEAELQDATLALHGLTVEDEGIYTCEFVTFPKGSVRGMTWL

SEQ ID NO: 1344 - protein, 125 aa, synthetic construct
  REGION 1..125: note = CD112 v25 IgV
QDVRVQVLPEVRGQLGGTVELPCHLLPPVPGLHISLVTWQRPDAPAKHQNVAAFHPKMGPSFPSPKPGSERLSFVSAKQSTGQDTEAELQDATLALHGLTVEDEGNYTCEFVTFPKGSVRGMTWL

SEQ ID NO: 1345 - protein, 125 aa, synthetic construct
  REGION 1..125: note = CD112 v26 IgV
QDVRVQVLPEVRGQLGGTVELPCHLLPPVPGLHISLVTWQRPDAPANHQNVAAFHPKMGPSFPSPKPGSERLSFVSAKQSTGQDTEAELQDATLALHGLTVEDEGYYTCEFVTFPKGSVRGMTWL

SEQ ID NO: 1346 - protein, 125 aa, synthetic construct
  REGION 1..125: note = CD112 v27 IgV
QDVRVQVLPEVRGQLGGTVELPCHLLPPVPGLYISLVTWQRPDAPANHQNVAAFHPKMGPSFPSPKPGSERLSFVSARQSTGQGTEAELQDATLALHGLTVEDEGNYTCEFVTSPKGSVRGMTWL

SEQ ID NO: 1347 - protein, 125 aa, synthetic construct
  REGION 1..125: note = CD112 v28 IgV
QDVRVQVLPEVRGQLGGTVELPCHLLPPVPGLHISLVTWQRPDAPAKHQNVAALHPKMGPSFPSPKPGSERLSFVSAKQSTGQDTEAELQDATLALHGLTVEDEGNYTCEFVTFPKGSVRGMTWL

SEQ ID NO: 1348 - protein, 125 aa, synthetic construct
  REGION 1..125: note = CD112 v29 IgV
QDVRVQVLPEVRGQLGGTVELPCHLLPPVPGLHISLVTWQRPDAPANHQNVAAFHPKMGPSFPSPKPGSERLSFVSAKQSTGQDTEAELQDATLALHGLTVEDEGNYTCEFVTFPKGSVRGMTWL

SEQ ID NO: 1349 - protein, 125 aa, synthetic construct
  REGION 1..125: note = CD112 v30 IgV
QDVRVQVLPEVRGQLGGTVELPCHLLPPVPGLYISLVTWQRPDAPANHQNVAAFHPKMGPSFPSPKPGSERLSFVSAKQSTGQDTEAELQDATLVLHGLTVEDEGNYTCEFVTFPKGSVRGMTWL

SEQ ID NO: 1350 - protein, 125 aa, synthetic construct
  REGION 1..125: note = CD112 v31 IgV
QDVRVQVLPEVWGQLGGTVELPCHLLPPVPGLYISLVTWQRPDAPANHQNVAAFHPKMGPSFPSPKPGSERLSFVSAKQSTGQDTEAELQDATLALHGLTVEDEGNYTCEFVTFPKGSVRGMTWL

SEQ ID NO: 1351 - protein, 125 aa, synthetic construct
  REGION 1..125: note = CD112 v32 IgV
QDVRVQVLPEVWGQLGGTVELPCHLLSPVPGLYISLVTWQRPDAPANHQNVAAFHPKMGPSFPSPKPGSERLSFVSAKQSTGQDTEAELQDATLALHGLTVEDEGNYTCEFVTFPKGSVRGMTWL

SEQ ID NO: 1352 - protein, 125 aa, synthetic construct
  REGION 1..125: note = CD112 v33 IgV
QDVRVQVLPEVRGQLGGTVELPCHLLPPVPGLHISLVTWQRPDAPANHQNMAAFHPKMGPSFPSPKPGSERLSFVSAKQSTGQDTEAELQDATLALHGLTVEDEGNYTCEFVTFPKGSVRGMTWL

SEQ ID NO: 1353 - protein, 125 aa, synthetic construct
  REGION 1..125: note = CD112 v34 IgV
QDVRVQVLPEVRGQLGGTVELPCHLLPPVPGLHISLVTWQRPDAPANHQNVAAFHPKMGPSFPSPKPGSERLSFVSAKQSTGQDTEAELQDATLALHGLTVEDEGNYTCEFVTFPKGTVRGMTWL

SEQ ID NO: 1354 - protein, 125 aa, synthetic construct
  REGION 1..125: note = CD112 v35 IgV
QDVRVQVLPEVRGQLGGTVELPCHLLPPVPGLHISLVTWQRPDAPANHQNVAAFHPKMGPSFPSPKPGSERLSFVSAKQSTGQDTEAELQDATLALHGLTAEDEGNYTCEFVTFSKGSVRGMTWL

SEQ ID NO: 1355 - protein, 125 aa, synthetic construct
  REGION 1..125: note = CD112 v36 IgV
QDVRVQVLPEVRGQLGGTVELPCRLLPPVPGLYISLVNWQRPGAPANHQNVAAFHPKMGPSFPSPKPGSERLSFVSAKQSTGQDTEAELQDATLALHGLTVEDEGNYTCEFVTFPKGSVRGMTWL

SEQ ID NO: 1356 - protein, 125 aa, synthetic construct
  REGION 1..125: note = CD112 v37 IgV
QDVRVQVLPEVRGQLGGTVELPCHLLPPVPGLYISLVTWQRPDAPANHQNVAAFHPKMGPSFPSPKPGSERLSFVSAKQSTGQDTEAELQDATLALHGLTVEDEGNYTCEFVTFPKGSVRGMTWL

SEQ ID NO: 1357 - protein, 125 aa, synthetic construct
  REGION 1..125: note = CD112 v38 IgV
QDVRVQVLPEVRGQLGGTVELPCHLLAPVPGLYISLVTWQRPDAPANHQNVAAFHPKMGPSFPSPKPGSERLSFVSAKQSTGQDTEAELQDATLALHGLTVEDEGNYTCEFVTFPKGSVRGMTWL

SEQ ID NO: 1358 - protein, 125 aa, synthetic construct
  REGION 1..125: note = CD112 v39 IgV
QDVRVQVLPEVRGQLGGTVELPCHLLPPVPGLYISLVTWQRPDAPANHQNVAAFHPKMGPSFPSPKPGSERLSFVSAKQSTGQDTEAELQDATLALHGLTVEDEGNYTCEFVTFPKGTVRGMTWL

SEQ ID NO: 1359 - protein, 125 aa, synthetic construct
  REGION 1..125: note = CD112 v40 IgV
QDVRVQVLPEVWGQLGGTVELPCHLLPPVPGLYISLVTWQRPDAPANHQNVAAFHPKMGPSFPSPKPGSERLSFVSAKQSTGQDTEAELQDATLALHGLTVEDEGNYTCEFVTFPKGSVRGITWL

SEQ ID NO: 1360 - protein, 125 aa, synthetic construct
  REGION 1..125: note = CD112 v41 IgV
QDVRVQVLPEVRGQLGGTVELPCHLLPPVPGLYISLVTWQRPDAPANHQNVAAFHPKMGPSFPSPKPGSERLSFVSAKQSTGKDTEAELQDATLALHGLTVEDEGYYTCEFVTFPKGSVRGMTWL

SEQ ID NO: 1361 - protein, 125 aa, synthetic construct
  REGION 1..125: note = CD112 v42 IgV
QDVRVQVLPEVWGQLGGTVELPCHLLSPVPGLYISLVTWQRPDAPANHQNVAAFHPKMGPSFPSPKPGSERLSFVSAKQSTGQDTEAELQDATLALHGLTVEDEGNYTCEFVTFPKGTVRGMTWL

SEQ ID NO: 1362 - protein, 125 aa, synthetic construct
  REGION 1..125: note = CD112 v43 IgV
QDVRVQVLPEVRGQLGGTVELPCHLLPSVPGLHISLVTWQRPDAPANHQNVAAFHPKMGPSFPSPKPGSERLSFVSAKQSTGQDTEAELQDATLALHGLTVEDEGNYTCEFVTFPKGSVRGMTWL

SEQ ID NO: 1363 - protein, 125 aa, synthetic construct
  REGION 1..125: note = CD112 v44 IgV
QDVRVQVLPEVRGQLGGTVELPCHLLSPVPGLYISLVTWQRPDAPANHQNVAAFHPKMGPSFPSPKPGSERLSFVSAKQSTGQDTEAELRDATLALHGLTVEDEGNYTCEFVTFPKGSVRGMTWL

SEQ ID NO: 1364 - protein, 125 aa, synthetic construct
  REGION 1..125: note = CD112 v45 IgV
QDVRVQVLPEVRGQVGGTVELPCHLLAPVPGLYISLVTWQRPDAPANHQNVAAFHPKMGPSFPSPKPGSERLSFVSAKQSTGQDTEAELQDATLALHGLTVEDEGNYTCEFVTFPKGTVRGMTWL

SEQ ID NO: 1365 - protein, 125 aa, synthetic construct
  REGION 1..125: note = CD112 v46 IgV
QDVRVQVLPEVRGQLGGTVELPCHLLPPVPGLHISLVTWQRPDAPANHQNVAAFHPKMGPSFPSPKPGSERLSFVSAKQSTGQDTEAELQDATLALHGLTVEDEGYYICEFVTFPKGSVRGMTWL

SEQ ID NO: 1366 - protein, 125 aa, synthetic construct
  REGION 1..125: note = CD112 v47 IgV
QDVRVQVLPEVRGQLGGTVELPCHLLPPVPGLHISLVTWQRPDAPANHQNVAAFHLKMGPSFPSPKPGSERLSFMSAKQSTGQDTEAELQDATLALHGLTMEDEGNYTCEFVTFPKGSVRGMTWL

SEQ ID NO: 1367 - protein, 127 aa, Homo sapiens
  REGION 1..127: note = MISC_FEATURE - CD112 IgV Wildtype
QDVRVQVLPEVRGQLGGTVELPCHLLPPVPGLYISLVTWQRPDAPANHQNVAAFHPKMGPSFPSPKPGSERLSFVSAKQSTGQDTEAELQDATLALHGLTVEDEGNYTCEFATFPKGSVRGMTWLRV

SEQ ID NO: 1368 - protein, 127 aa, synthetic construct
  REGION 1..127: note = CD112 v1 IgV
QDVRVQVLPEVRGQLGGTVELPCHLLPPVPGLHISLVTWQRPDAPANHQNVAAFHPKMGPSFPSPKPGSERLSFVSAKQSTGQDTEAELQDATLALHGLTVEDEGNYTCEFVTFPKDSVRGMTWLRV

SEQ ID NO: 1369 - protein, 127 aa, synthetic construct
  REGION 1..127: note = CD112 v2 IgV
QDVRVQVLPEVRGQLGGTAELPCHLLPPVPGLHISLVTWQRPDAPANHQNVAAFHPKMGPSFPGPKPGSERLSFVSAKQGTGQDTEAELQDATLALHSLTVEDEGYYTCEFVTFPKGSVRGMTWLRV

SEQ ID NO: 1370 - protein, 127 aa, synthetic construct
  REGION 1..127: note = CD112 v3 IgV
QDVRVQVLPEVRGQLGGTVELPCHLLPPVPGPYISLVTWQRPDAPANHQNVAAFHPKMGPSFPSPKPGSERLSFVSAKQSTGQDTEAELQDATLALHGLTVEDEGNYTCEFVTFPKGSVRGMTWLRV

SEQ ID NO: 1371 - protein, 127 aa, synthetic construct
  REGION 1..127: note = CD112 v4 IgV
QDVRVQVLPEVRGQLGGTVELPCHLLPPVPGLYISLVTWQRPDAPANHQNVAAFHPKMGPSFPSPKPGSERLSFVSAKQSTGQDTEAELQDATLVLHGLTVEDEGNYTCEFITFPKGSVRGMTWLRV

SEQ ID NO: 1372 - protein, 127 aa, synthetic construct
  REGION 1..127: note = CD112 v5 IgV
QDVRVQVLPEVRGQLGGTVELPCHLLPSVPGLYISLVTWQRPDAPANHQNVAAFHPKMGPSFPSPKPGSERLSFVSAKQSTGQDTEAELQDATLALHGLTVEDEGNYTCEFVTFPKGSVRGMTWLRV

SEQ ID NO: 1373 - protein, 127 aa, synthetic construct
  REGION 1..127: note = CD112 v6 IgV
QDVRVQVLPEVRGQLGGTVELPCHLLAPVPGLYISLVNWQRPDAPANHQNVAAFHPKMGPSFPSPKPGSERLSFVSAKQSTGQDTEAELQDATLALHGLTAEDEGNYTCEFVTFPKGSVRGMTWLRV

SEQ ID NO: 1374 - protein, 127 aa, synthetic construct
  REGION 1..127: note = CD112 v7 IgV
QDVRVQVLPEVRGQLGGTVELPCHLLPPVPGLYISLVTWQRPDAPANHQNVAAFHPKMGPSFPSPKPGSERLSFVSAKQSTGQDTEAELQDATLALHGLTVEDEGNYTCEFATFPKGFVRGMTWLRV

SEQ ID NO: 1375 - protein, 127 aa, synthetic construct
  REGION 1..127: note = CD112 v8 IgV
QDVRVQVLPEVWGQLGGTVELPCHLLPPVPGLYISLVTWQRPDAPANYQNVAASHPKMGPSFPSPKPGSERLSFVSAKQSTGQDTEAELQDATLALHGLTVEDEGNYTCEFATFPKGFVRGMTWLRV

SEQ ID NO: 1376 - protein, 127 aa, synthetic construct
  REGION 1..127: note = CD112 v9 IgV
QDVRVQVLPEVWGQLGGTVELPCHLLPPVPGLYISLVTWQRPDAPANHQNVAAFHPKMGPSFPSPKPGSERLSFVSAKRSTGQDTEAELQDATLALHGLTVEDEGNYTCEFATFPKGFVRGMTWLRV

SEQ ID NO: 1377 - protein, 127 aa, synthetic construct
  REGION 1..127: note = CD112 v10 IgV
QDVRVQVLPEVRGQLGGTVELPCHLLPPVPGLYISLVTWQRPDAPANHQNVAAFHPKMGPSFPSPKPGSERLSFVSAKQSTGQDTEAELQDATLALHGLTVEDEGNYTCEFASFPKGYVRGMTWLRV

SEQ ID NO: 1378 - protein, 127 aa, synthetic construct
  REGION 1..127: note = CD112 v11 IgV
QDVRVQVLPEVRGQLGGTVELPCHLLPPVPGLYISLVTWQRPDAPANHQNVAAFHPKMGPSFPSPKPGSERLSFVSAKQSTGQDTEAELQDATLALHGLTVEDEGNYTCEFATFPKGYVRGMTWLRV

SEQ ID NO: 1379 - protein, 127 aa, synthetic construct
  REGION 1..127: note = CD112 v12 IgV
QDVRVQVLPEVRGQLGGTVELPCHLLPPVPGLYISLVTWQRPDAPANHQNVAAFHPKMGPSFPSPKPGSERLSFVSAKQSTGQDTEAELQDATLALHGLTVEDEGIYTCEFATFPKGYVRGMTWLRV

SEQ ID NO: 1380 - protein, 127 aa, synthetic construct
  REGION 1..127: note = CD112 v13 IgV
QDVRVQVLPEVRGQLGGTVELPCHLLPPVPGLYISLVTWQRPDAPANHQNVAAFHPKMGPSFPSPKPGSERLSFVSAKQSTGQDTEAELQDATLALHGLTVEDEGIYTCEFATFPKGFVRGMTWLRV

SEQ ID NO: 1381 - protein, 127 aa, synthetic construct
  REGION 1..127: note = CD112 v14 IgV
QDVRVQVLPEVRGQLGGTVELPCHLLPPVPGLYISLVTWQRPDAPANHQNVAAFHPKMGPSFPSPKPGSERLSFVSAKQSTGQDTEAELQDATLTPHGLTVEDEGNYTCEFATFPKGYVRGMTWLRV

SEQ ID NO: 1382 - protein, 127 aa, synthetic construct
  REGION 1..127: note = CD112 v15 IgV
QDVRVQVLPEVRGQLGGTVELPCHLLPPVPGLHISLVTWQRPDAPANHQNVAAFHPKMGPSFPSPKSGSERLSFVSAKQSTGQDTEAELQDATLALHGLTVEDEGYYTCEFVTFPKGSVRGMTWLRV

SEQ ID NO: 1383 - protein, 127 aa, synthetic construct
  REGION 1..127: note = CD112 v16 IgV
QDVRVQVLPEVRGQLGGTVELPCHLLPPVPGLYISLVTWQRPDAPANHQNVAAFHPKMGPSFPSPKPGSERLSFVSAKQSTGQDTEAELQDATLALHGLTVEDEGYYTCEFVTFPKGSVRGMTWLRV

SEQ ID NO: 1384 - protein, 127 aa, synthetic construct
  REGION 1..127: note = CD112 v17 IgV
QDVRVQVLPEVRGQLGGSVELPCHLLPPVPGLHISLVTWQRPDAPANHQNVAAFHPKMGPSFPSPKPGSERLSFVSAKQSTGQDTEAELQDATLALHGLTVEDEGNYTCEFVTFPKGSVRGMTWLRV

SEQ ID NO: 1385 - protein, 127 aa, synthetic construct
  REGION 1..127: note = CD112 v18 IgV
QDVRVQVLSEVRGQLGGTVELPCHLLPPVPGLHISLVTWQRPDAPASHQNVAAFHPKMGPSFPSPKPGSERLSFVSAKQSTGQDTEAELQDATLALHGLTVEDEGNYTCEFVTFPKGSVRGMTWLRV

SEQ ID NO: 1386 - protein, 127 aa, synthetic construct
  REGION 1..127: note = CD112 v19 IgV
QDVRVQVLPEVRGQLGGTVELPCHLLPPVPGLYISLVTWQRSDAPANHQNVAAFHPKMGPSFPSPKHGSERLSFVSAKQSTGQDTEAELQDATLALHGLTVEDEGNYTCEFVTFPKGSVRGMTWLRV

SEQ ID NO: 1387 - protein, 127 aa, synthetic construct
  REGION 1..127: note = CD112 v20 IgV
QDVRVQVLPEVRGQLGGTVELPCHLLLPVPGPYISLVTWQRSDAPANHQNVAAFHPKMGPSFPSPKPGSERLSFVSAKQSTGQDTEAELQDATLALHGLTVEDEGNYTCEFVTFPKGSVRGMTWLRV

SEQ ID NO: 1388 - protein, 127 aa, synthetic construct
  REGION 1..127: note = CD112 v21 IgV
QDVRVQVLPEVRGQLGGTVELPCHLLPPVPGLYISLVTWQRPDAPANHQNVAAFHPKMGPSFPSPKPGSERLSFVSAKQSTGQDTEAELQDATLALHDLTVEDEGNYTCEFVTFPKGSVRGMTWLRV

SEQ ID NO: 1389 - protein, 127 aa, synthetic construct
  REGION 1..127: note = CD112 v22 IgV
QDVRVQVLPEVRGQLGGTVELPCHLLPPVPGLHIPLVTWQRPDAPANHQNVAAFHPKMGPSFPSPKPGSERLSFVSAKQSTGQDTEAELQDATLALHGLTVEDEGYYTCEFVTFPKGSVRGMTWLRV

SEQ ID NO: 1390 - protein, 127 aa, synthetic construct
  REGION 1..127: note = CD112 v23 IgV
QDVRVQVLPEVRGQLGGTVELPCHLLPPVPGPYISLVTWQRSDAPANHQNVAAFHPKMGPSFPSPKPGSERLSFVSAKQSTGQDTEAELQDATLALHGLAVEDEGNYTCEFVTFPKGSVRGMTWLRV

SEQ ID NO: 1391 - protein, 127 aa, synthetic construct
  REGION 1..127: note = CD112 v24 IgV
QDVRVQVLPEVRGQLGGTVELPCHLLSPVPGLYISLVTWQRPDASANHQNVAAFHPKMGPSFPSPKPGSERLSFVSAKQSTGQDTEAELQDATLALHGLTVEDEGIYTCEFVTFPKGSVRGMTWLRV

SEQ ID NO: 1392 - protein, 127 aa, synthetic construct
  REGION 1..127: note = CD112 v25 IgV
QDVRVQVLPEVRGQLGGTVELPCHLLPPVPGLHISLVTWQRPDAPAKHQNVAAFHPKMGPSFPSPKPGSERLSFVSAKQSTGQDTEAELQDATLALHGLTVEDEGNYTCEFVTFPKGSVRGMTWLRV

SEQ ID NO: 1393 - protein, 127 aa, synthetic construct
  REGION 1..127: note = CD112 v26 IgV
QDVRVQVLPEVRGQLGGTVELPCHLLPPVPGLHISLVTWQRPDAPANHQNVAAFHPKMGPSFPSPKPGSERLSFVSAKQSTGQDTEAELQDATLALHGLTVEDEGYYTCEFVTFPKGSVRGMTWLRV

SEQ ID NO: 1394 - protein, 127 aa, synthetic construct
  REGION 1..127: note = CD112 v27 IgV
QDVRVQVLPEVRGQLGGTVELPCHLLPPVPGLYISLVTWQRPDAPANHQNVAAFHPKMGPSFPSPKPGSERLSFVSARQSTGQGTEAELQDATLALHGLTVEDEGNYTCEFVTSPKGSVRGMTWLRV

SEQ ID NO: 1395 - protein, 127 aa, synthetic construct
  REGION 1..127: note = CD112 v28 IgV
QDVRVQVLPEVRGQLGGTVELPCHLLPPVPGLHISLVTWQRPDAPAKHQNVAALHPKMGPSFPSPKPGSERLSFVSAKQSTGQDTEAELQDATLALHGLTVEDEGNYTCEFVTFPKGSVRGMTWLRV

SEQ ID NO: 1396 - protein, 127 aa, synthetic construct
  REGION 1..127: note = CD112 v29 IgV
QDVRVQVLPEVRGQLGGTVELPCHLLPPVPGLHISLVTWQRPDAPANHQNVAAFHPKMGPSFPSPKPGSERLSFVSAKQSTGQDTEAELQDATLALHGLTVEDEGNYTCEFVTFPKGSVRGMTWLRV

SEQ ID NO: 1397 - protein, 127 aa, synthetic construct
  REGION 1..127: note = CD112 v30 IgV
QDVRVQVLPEVRGQLGGTVELPCHLLPPVPGLYISLVTWQRPDAPANHQNVAAFHPKMGPSFPSPKPGSERLSFVSAKQSTGQDTEAELQDATLVLHGLTVEDEGNYTCEFVTFPKGSVRGMTWLRV

SEQ ID NO: 1398 - protein, 127 aa, synthetic construct
  REGION 1..127: note = CD112 v31 IgV
QDVRVQVLPEVWGQLGGTVELPCHLLPPVPGLYISLVTWQRPDAPANHQNVAAFHPKMGPSFPSPKPGSERLSFVSAKQSTGQDTEAELQDATLALHGLTVEDEGNYTCEFVTFPKGSVRGMTWLRV

SEQ ID NO: 1399 - protein, 127 aa, synthetic construct
  REGION 1..127: note = CD112 v32 IgV
QDVRVQVLPEVWGQLGGTVELPCHLLSPVPGLYISLVTWQRPDAPANHQNVAAFHPKMGPSFPSPKPGSERLSFVSAKQSTGQDTEAELQDATLALHGLTVEDEGNYTCEFVTFPKGSVRGMTWLRV

SEQ ID NO: 1400 - protein, 127 aa, synthetic construct
  REGION 1..127: note = CD112 v33 IgV
QDVRVQVLPEVRGQLGGTVELPCHLLPPVPGLHISLVTWQRPDAPANHQNMAAFHPKMGPSFPSPKPGSERLSFVSAKQSTGQDTEAELQDATLALHGLTVEDEGNYTCEFVTFPKGSVRGMTWLRV

SEQ ID NO: 1401 - protein, 127 aa, synthetic construct
  REGION 1..127: note = CD112 v34 IgV
QDVRVQVLPEVRGQLGGTVELPCHLLPPVPGLHISLVTWQRPDAPANHQNVAAFHPKMGPSFPSPKPGSERLSFVSAKQSTGQDTEAELQDATLALHGLTVEDEGNYTCEFVTFPKGTVRGMTWLRV

SEQ ID NO: 1402 - protein, 127 aa, synthetic construct
  REGION 1..127: note = CD112 v35 IgV
QDVRVQVLPEVRGQLGGTVELPCHLLPPVPGLHISLVTWQRPDAPANHQNVAAFHPKMGPSFPSPKPGSERLSFVSAKQSTGQDTEAELQDATLALHGLTAEDEGNYTCEFVTFSKGSVRGMTWLRV

SEQ ID NO: 1403 - protein, 127 aa, synthetic construct
  REGION 1..127: note = CD112 v36 IgV
QDVRVQVLPEVRGQLGGTVELPCRLLPPVPGLYISLVNWQRPGAPANHQNVAAFHPKMGPSFPSPKPGSERLSFVSAKQSTGQDTEAELQDATLALHGLTVEDEGNYTCEFVTFPKGSVRGMTWLRV

SEQ ID NO: 1404 - protein, 127 aa, synthetic construct
  REGION 1..127: note = CD112 v37 gV
QDVRVQVLPEVRGQLGGTVELPCHLLPPVPGLYISLVTWQRPDAPANHQNVAAFHPKMGPSFPSPKPGSERLSFVSAKQSTGQDTEAELQDATLALHGLTVEDEGNYTCEFVTFPKGSVRGMTWLRV

SEQ ID NO: 1405 - protein, 127 aa, synthetic construct
  REGION 1..127: note = CD112 v38 gV
QDVRVQVLPEVRGQLGGTVELPCHLLAPVPGLYISLVTWQRPDAPANHQNVAAFHPKMGPSFPSPKPGSERLSFVSAKQSTGQDTEAELQDATLALHGLTVEDEGNYTCEFVTFPKGSVRGMTWLRV

SEQ ID NO: 1406 - protein, 127 aa, synthetic construct
  REGION 1..127: note = CD112 v39 gV
QDVRVQVLPEVRGQLGGTVELPCHLLPPVPGLYISLVTWQRPDAPANHQNVAAFHPKMGPSFPSPKPGSERLSFVSAKQSTGQDTEAELQDATLALHGLTVEDEGNYTCEFVTFPKGTVRGMTWLRV

SEQ ID NO: 1407 - protein, 127 aa, synthetic construct
  REGION 1..127: note = CD112 v40 gV
QDVRVQVLPEVWGQLGGTVELPCHLLPPVPGLYISLVTWQRPDAPANHQNVAAFHPKMGPSFPSPKPGSERLSFVSAKQSTGQDTEAELQDATLALHGLTVEDEGNYTCEFVTFPKGSVRGITWLRV

SEQ ID NO: 1408 - protein, 127 aa, synthetic construct
  REGION 1..127: note = CD112 v41 gV
QDVRVQVLPEVRGQLGGTVELPCHLLPPVPGLYISLVTWQRPDAPANHQNVAAFHPKMGPSFPSPKPGSERLSFVSAKQSTGKDTEAELQDATLALHGLTVEDEGYYTCEFVTFPKGSVRGMTWLRV

SEQ ID NO: 1409 - protein, 127 aa, synthetic construct
  REGION 1..127: note = CD112 v42 gV
QDVRVQVLPEVWGQLGGTVELPCHLLSPVPGLYISLVTWQRPDAPANHQNVAAFHPKMGPSFPSPKPGSERLSFVSAKQSTGQDTEAELQDATLALHGLTVEDEGNYTCEFVTFPKGTVRGMTWLRV

SEQ ID NO: 1410 - protein, 127 aa, synthetic construct
  REGION 1..127: note = CD112 v43 gV
QDVRVQVLPEVRGQLGGTVELPCHLLPSVPGLHISLVTWQRPDAPANHQNVAAFHPKMGPSFPSPKPGSERLSFVSAKQSTGQDTEAELQDATLALHGLTVEDEGNYTCEFVTFPKGSVRGMTWLRV

SEQ ID NO: 1411 - protein, 127 aa, synthetic construct
  REGION 1..127: note = CD112 v44 gV
QDVRVQVLPEVRGQLGGTVELPCHLLSPVPGLYISLVTWQRPDAPANHQNVAAFHPKMGPSFPSPKPGSERLSFVSAKQSTGQDTEAELRDATLALHGLTVEDEGNYTCEFVTFPKGSVRGMTWLRV

SEQ ID NO: 1412 - protein, 127 aa, synthetic construct
  REGION 1..127: note = CD112 v45 IgV
QDVRVQVLPEVRGQVGGTVELPCHLLAPVPGLYISLVTWQRPDAPANHQNVAAFHPKMGPSFPSPKPGSERLSFVSAKQSTGQDTEAELQDATLALHGLTVEDEGNYTCEFVTFPKGTVRGMTWLRV

SEQ ID NO: 1413 - protein, 127 aa, synthetic construct
  REGION 1..127: note = CD112 v46 IgV
QDVRVQVLPEVRGQLGGTVELPCHLLPPVPGLHISLVTWQRPDAPANHQNVAAFHPKMGPSFPSPKPGSERLSFVSAKQSTGQDTEAELQDATLALHGLTVEDEGYYICEFVTFPKGSVRGMTWLRV

SEQ ID NO: 1414 - protein, 127 aa, synthetic construct
  REGION 1..127: note = CD112 v47 IgV
QDVRVQVLPEVRGQLGGTVELPCHLLPPVPGLHISLVTWQRPDAPANHQNVAAFHLKMGPSFPSPKPGSERLSFMSAKQSTGQDTEAELQDATLALHGLTMEDEGNYTCEFVTFPKGSVRGMTWLRV

SEQ ID NO: 1415 - protein, 329 aa, synthetic construct
  REGION 1..329: note = CD112 v48 ECD
QDVRVQVLPEVRGQLGGTVELPCHLLPPVPGLYISLVTWQRPDAPAKHQNVAAFHPKMGPSFPSPKPGSERLSFVSAKRSTGQDTEAELQDATLALHGLTVEDEGNYTCEFATFPKGFVRGMTWLRVIAKPKNQAEAQKVTFSQDPTTVALCISKEGRPPARISWLSSLDWEAKETQVSGTLAGTVTVTSRFTLVPSGRADGVTVTCKVEHESFEEPALIPVTLSVRYPPEVSISGYDDNWYLGRTDATLSCDVRSNPEPTGYDWSTTSGTFPTSAVAQGSQLVIHAVDSLFNTTFVCTVTNAVGMGRAEQVIFVRETPNTAGAGATGG

SEQ ID NO: 1416 - protein, 329 aa, synthetic construct
  REGION 1..329: note = CD112 v49 ECD
QDVRVQVLPEVRGQLGGTVELPCHLLPPVPGLYISLVTWRRPDAPANHQNVAAFHPKMGTSFPSPKPGSERLSFVSAKQSTGQDTEAELQDATLALHGLTVEDEGNYTCEFVTFPKGTVRGMTWLRVIAKPKNQAEAQKVTFSQDPTTVALCISKEGRPPARISWLSSLDWEAKETQVSGTLAGTVTVTSRFTLVPSGRADGVTVTCKVEHESFEEPALIPVTLSVRYPPEVSISGYDDNWYLGRTDATLSCDVRSNPEPTGYDWSTTSGTFPTSAVAQGSQLVIHAVDSLFNTTFVCTVTNAVGMGRAEQVIFVRETPNTAGAGATGG

SEQ ID NO: 1417 - protein, 329 aa, synthetic construct
  REGION 1..329: note = CD112 v50 ECD
QDVRVQVLPEVRGQLGGTVELPCHLLPPVPGLYISLVTWQRPDAPANHQNVAAFHPKMGPSFPSPKPGSERLSFVSAKQSTGQDTEAELQDATLALHGLTVEDEGNYTCEFATYPKGFVRGMTWLRVIAKPKNQAEAQKVTFSQDPTTVALCISKEGRPPARISWLSSLDWEAKETQVSGTLAGTVTVTSRFTLVPSGRADGVTVTCKVEHESFEEPALIPVTLSVRYPPEVSISGYDDNWYLGRTDATLSCDVRSNPEPTGYDWSTTSGTFPTSAVAQGSQLVIHAVDSLFNTTFVCTVTNAVGMGRAEQVIFVRETPNTAGAGATGG

SEQ ID NO: 1418 - protein, 329 aa, synthetic construct
  REGION 1..329: note = CD112 v51 ECD
QDVRVQVLPEVRGQLGGTVELPCHLLPPVPGLHISLVTWQRPDAPANHQNVAAFHPKMGPSFPSPKPGSERLSFVSARQSTGQDTEAELQDATLALHGLTVEDEGNYTCEFATFPKGYVRGMTWLRVIAKPKNQAEAQKVTFSQDPTTVALCISKEGRPPARISWLSSLDWEAKETQVSGTLAGTVTVTSRFTLVPSGRADGVTVTCKVEHESFEEPALIPVTLSVRYPPEVSISGYDDNWYLGRTDATLSCDVRSNPEPTGYDWSTTSGTFPTSAVAQGSQLVIHAVDSLFNTTFVCTVTNAVGMGRAEQVIFVRETPNTAGAGATGG

SEQ ID NO: 1419 - protein, 329 aa, synthetic construct
  REGION 1..329: note = CD112 v52 ECD
QDVRVQVLPEVWGQLGGTVELPCHLLPPVPGLYISLVTWQRPDAPTNHQNVAAFHPKMGPSFPSPMPGSERLSFVSAKRSTGQDTEAELQDATLALHGLTVEDEGIYTCEFAAFPKGFVRGMTWLRVIAKPKNQAEAQKVTFSQDPTTVALCISKEGRPPARISWLSSLDWEAKETQVSGTLAGTVTVTSRFTLVPSGRADGVTVTCKVEHESFEEPALIPVTLSVRYPPEVSISGYDDNWYLGRTDATLSCDVRSNPEPTGYDWSTTSGTFPTSAVAQGSQLVIHAVDSLFNTTFVCTVTNAVGMGRAEQVIFVRETPNTAGAGATGG

SEQ ID NO: 1420 - protein, 329 aa, synthetic construct
  REGION 1..329: note = CD112 v53 ECD
QDVRVQVLPEVRGQLGGTVELPCHLLPPVPGLHISLVTWQRPDAPANHQNVAAFHPKMGPSFPSPKPGSERLSFVSAKQSTGQDTEAELQDATLALHGLTVEDEGNYTCEFVTFPKGFVRGMTWLRVIAKPKNQAEAQKVTFSQDPTTVALCISKEGRPPARISWLSSLDWEAKETQVSGTLAGTVTVTSRFTLVPSGRADGVTVTCKVEHESFEEPALIPVTLSVRYPPEVSISGYDDNWYLGRTDATLSCDVRSNPEPTGYDWSTTSGTFPTSAVAQGSQLVIHAVDSLFNTTFVCTVTNAVGMGRAEQVIFVRETPNTAGAGATGG

SEQ ID NO: 1421 - protein, 329 aa, synthetic construct
  REGION 1..329: note = CD112 v54 ECD
QDVRVQVLPEVWGQLGGTVELPCHLLPPVPGLHISLVTWQRPDAPANHQNVAAFHPKMGPSFPSPKPGSERLSFVSAKQSTGQDTEAELQDATLALHGLTVEDEGIYTCEFATFPKGFVRGMTWLRVIAKPKNQAEAQKVTFSQDPTTVALCISKEGRPPARISWLSSLDWEAKETQVSGTLAGTVTVTSRFTLVPSGRADGVTVTCKVEHESFEEPALIPVTLSVRYPPEVSISGYDDNWYLGRTDATLSCDVRSNPEPTGYDWSTTSGTFPTSAVAQGSQLVIHAVDSLFNTTFVCTVTNAVGMGRAEQVIFVRETPNTAGAGATGG

SEQ ID NO: 1422 - protein, 329 aa, synthetic construct
  REGION 1..329: note = CD112 v55 ECD
QDVRVQVLPEVRGQVGGTVELPCHLLPPVPGLYISLVTWQRPDAPANHQNVAAFHPKMGPSFPSPKPGSERLSFVSAKQSTGQDTEAELRDATLALHGLTVEDEGNYTCEFATFPKGFVRGMTWLRVIAKPKNQAEAQKVTFSQDPTTVALCISKEGRPPARISWLSSLDWEAKETQVSGTLAGTVTVTSRFTLVPSGRADGVTVTCKVEHESFEEPALIPVTLSVRYPPEVSISGYDDNWYLGRTDATLSCDVRSNPEPTGYDWSTTSGTFPTSAVAQGSQLVIHAVDSLFNTTFVCTVTNAVGMGRAEQVIFVRETPNTAGAGATGG

SEQ ID NO: 1423 - protein, 329 aa, synthetic construct; identical to SEQ ID NO: 1422
  REGION 1..329: note = CD112 v56 ECD

SEQ ID NO: 1424 - protein, 329 aa, synthetic construct
  REGION 1..329: note = CD112 v57 ECD
QDVRVQVLPEVRGQLGGTVELPCHLLPPVPGPYISLVTWQRPDAPANHQNVAAFHPKMGPSFPSPKPGSERLSFVSAKQSTGQDTEAELQDATLALHGLTVEDEGNYTCEFATFPKGFVRGMTWLRVIAKPKNQAEAQKVTFSQDPTTVALCISKEGRPPARISWLSSLDWEAKETQVSGTLAGTVTVTSRFTLVPSGRADGVTVTCKVEHESFEEPALIPVTLSVRYPPEVSISGYDDNWYLGRTDATLSCDVRSNPEPTGYDWSTTSGTFPTSAVAQGSQLVIHAVDSLFNTTFVCTVTNAVGMGRAEQVIFVRETPNTAGAGATGG

SEQ ID NO: 1425 - protein, 329 aa, synthetic construct
  REGION 1..329: note = CD112 v58 ECD
QDVRVQVLPEVRGQLGGTVELPCHLLPPVPGLHISLVTWQRPDAPANHQNVAAFHPKMGPSFPSPKPGSERLSFVSAKRSTGQDTEAELQDATLALHGLTVEDEGNYTCEFVTFPKGYVRGMTWLRVIAKPKNQAEAQKVTFSQDPTTVALCISKEGRPPARISWLSSLDWEAKETQVSGTLAGTVTVTSRFTLVPSGRADGVTVTCKVEHESFEEPALIPVTLSVRYPPEVSISGYDDNWYLGRTDATLSCDVRSNPEPTGYDWSTTSGTFPTSAVAQGSQLVIHAVDSLFNTTFVCTVTNAVGMGRAEQVIFVRETPNTAGAGATGG

SEQ ID NO: 1426 - protein, 329 aa, synthetic construct
  REGION 1..329: note = CD112 v59 ECD
QDVRVQVLPEVRGQLGGAVELPCHLLPPVPGLYISLVTWQRPDAPANHQNVAAFHPKMGPSFPSPKPGSERLSFVSAKQSTGQDTEAELQDATLALHGLTVEDEGIYTCEFATFPKGTVRGMTWLRVIAKPKNQAEAQKVTFSQDPTTVALCISKEGRPPARISWLSSLDWEAKETQVSGTLAGTVTVTSRFTLVPSGRADGVTVTCKVEHESFEEPALIPVTLSVRYPPEVSISGYDDNWYLGRTDATLSCDVRSNPEPTGYDWSTTSGTFPTSAVAQGSQLVIHAVDSLFNTTFVCTVTNAVGMGRAEQVIFVRETPNTAGAGATGG

SEQ ID NO: 1427 - protein, 329 aa, synthetic construct
  REGION 1..329: note = CD112 v60 ECD
QDVRVQVLPEVRGQVGGTVELPCHLLPPVPGLHISLVTWQRPDAPANHQNVAAFHPKMGPSFPSPKPGSERLSFVSAKQSTGQDTEAELQDATLALHGLTVEDEGYYTCEFVTFPKGFVRGMTWLRVIAKPKNQAEAQKVTFSQDPTTVALCISKEGRPPARISWLSSLDWEAKETQVSGTLAGTVTVTSRFTLVPSGRADGVTVTCKVEHESFEEPALIPVTLSVRYPPEVSISGYDDNWYLGRTDATLSCDVRSNPEPTGYDWSTTSGTFPTSAVAQGSQLVIHAVDSLFNTTFVCTVTNAVGMGRAEQVIFVRETPNTAGAGATGG

SEQ ID NO: 1428 - protein, 329 aa, synthetic construct
  REGION 1..329: note = CD112 v61 ECD
QDVRVQVLPEVRGQLGGTVELPCHLLPPVPGLYISLMTWQRPDAPANHQNVAAFHPKMGPSFPSPKPGSERLSFVSAKQSTGQDTEAELQDATLALHGLTVEDEGNYTCEFATFPKGFVRGMTWLRVIAKPKNQAEAQKVTFSQDPTTVALCISKEGRPPARISWLSSLDWEAKETQVSGTLAGTVTVTSRFTLVPSGRADGVTVTCKVEHESFEEPALIPVTLSVRYPPEVSISGYDDNWYLGRTDATLSCDVRSNPEPTGYDWSTTSGTFPTSAVAQGSQLVIHAVDSLFNTTFVCTVTNAVGMGRAEQVIFVRETPNTAGAGATGG

SEQ ID NO: 1429 - protein, 329 aa, synthetic construct
  REGION 1..329: note = CD112 v62 ECD
QDVRVQVLPEVRGQLGGTVELPCHLLPPVPGLYISLVTWQRPDAPAKHQNVAAFHPKMGPSFPSPKPGSERLSFVSAKQSTGQDTEAELQDATLALHGLTVEDEGNYTCEFVTFPKGYVRGMTWLRVIAKPKNQAEAQKVTFSQDPTTVALCISKEGRPPARISWLSSLDWEAKETQVSGTLAGTVTVTSRFTLVPSGRADGVTVTCKVEHESFEEPALIPVTLSVRYPPEVSISGYDDNWYLGRTDATLSCDVRSNPEPTGYDWSTTSGTFPTSAVAQGSQLVIHAVDSLFNTTFVCTVTNAVGMGRAEQVIFVRETPNTAGAGATGG

SEQ ID NO: 1430 - protein, 329 aa, synthetic construct
  REGION 1..329: note = CD112 v63 ECD
QDVRVQVLPEVRGQLGGTVELPCHLLPPVPGLYISLVTWQRPDAPTNHQNVAAFHPKMGPSFPSPKPGSERLSFVSAKQSTGQDTEAELQDATLALHGLTVEDEGNYTCEFVTFPKGSVRGMTWLRVIAKPKNQAEAQKVTFSQDPTTVALCISKEGRPPARISWLSSLDWEAKETQVSGTLAGTVTVTSRFTLVPSGRADGVTVTCKVEHESFEEPALIPVTLSVRYPPEVSISGYDDNWYLGRTDATLSCDVRSNPEPTGYDWSTTSGTFPTSAVAQGSQLVIHAVDSLFNTTFVCTVTNAVGMGRAEQVIFVRETPNTAGAGATGG

SEQ ID NO: 1431 - protein, 329 aa, synthetic construct
  REGION 1..329: note = CD112 v64 ECD
QDVRVQVLPEVRGQLGGTVELPCHLLPSVPGLHISLVTWQRPDAPANHQNVAAFHPKMGPSFPSPKPGSERLSFVSAKQSTGQDTEAELQDATLALHGLTVEDEGIYTCEFATFPKGYVRGMTWLRVIAKPKNQAEAQKVTFSQDPTTVALCISKEGRPPARISWLSSLDWEAKETQVSGTLAGTVTVTSRFTLVPSGRADGVTVTCKVEHESFEEPALIPVTLSVRYPPEVSISGYDDNWYLGRTDATLSCDVRSNPEPTGYDWSTTSGTFPTSAVAQGSQLVIHAVDSLFNTTFVCTVTNAVGMGRAEQVIFVRETPNTAGAGATGG

SEQ ID NO: 1432 - protein, 329 aa, synthetic construct
  REGION 1..329: note = CD112 v65 ECD
QDVRVQVLPEVRGQLGGTVELPCHLLPPVSGLHISLVTWQRPDAPAKHQNVAAFHPKMGPSFPSPKPGSERLSFMSAKRSTGQDTEAELQDATLALHGLTVEDEGIYTCEFATFPKGYVRGMTWLRVIAKPKNQAEAQKVTFSQDPTTVALCISKEGRPPARISWLSSLDWEAKETQVSGTLAGTVTVTSRFTLVPSGRADGVTVTCKVEHESFEEPALIPVTLSVRYPPEVSISGYDDNWYLGRTDATLSCDVRSNPEPTGYDWSTTSGTFPTSAVAQGSQLVIHAVDSLFNTTFVCTVTNAVGMGRAEQVIFVRETPNTAGAGATGG

SEQ ID NO: 1433 - protein, 329 aa, synthetic construct
  REGION 1..329: note = CD112 v66 ECD
QDVRVQVLPEVRGQLGGTAELPCHLLPPVPGLYISLVTWQRPDAPAKHQNVAAFHPKMGPSFPSPKPGSERLSFVSAKQSTGQDTEAELQDATLALHGLTVEDEGYYTCEFATFPEGYVRGMTWLRVIAKPKNQAEAQKVTFSQDPTTVALCISKEGRPPARISWLSSLDWEAKETQVSGTLAGTVTVTSRFTLVPSGRADGVTVTCKVEHESFEEPALIPVTLSVRYPPEVSISGYDDNWYLGRTDATLSCDVRSNPEPTGYDWSTTSGTFPTSAVAQGSQLVIHAVDSLFNTTFVCTVTNAVGMGRAEQVIFVRETPNTAGAGATGG

SEQ ID NO: 1434 - protein, 329 aa, synthetic construct
  REGION 1..329: note = CD112 v67 ECD
QDVRVQVLPEVRGQLGGTVELPCHLLPPVPGLYISLVTWQRPDAPANHQNVAAFHPKMGPSFPSPKPGSERLSFVSAKRSTGQDAEAELQDATLALHGLTVEDEGNYTCEFVTFPKGYVRGMTWLRVIAKPKNQAEAQKVTFSQDPTTVALCISKEGRPPARISWLSSLDWEAKETQVSGTLAGTVTVTSRFTLVPSGRADGVTVTCKVEHESFEEPALIPVTLSVRYPPEVSISGYDDNWYLGRTDATLSCDVRSNPEPTGYDWSTTSGTFPTSAVAQGSQLVIHAVDSLFNTTFVCTVTNAVGMGRAEQVIFVRETPNTAGAGATGG

SEQ ID NO: 1435 - protein, 329 aa, synthetic construct
  REGION 1..329: note = CD112 v68 ECD
QDVRVQVLPEVRGQLGGTVELPCHLLPPVPGLYISLVTWQRPDAPANHQNVAAFHPKMGPSFPSPKPGSERLSFVSAKQSTGQDTEAELQDATLALHGLTMEDEGIYTCEFATFPKGYVRGMTWLRVIAKPKNQAEAQKVTFSQDPTTVALCISKEGRPPARISWLSSLDWEAKETQVSGTLAGTVTVTSRFTLVPSGRADGVTVTCKVEHESFEEPALIPVTLSVRYPPEVSISGYDDNWYLGRTDATLSCDVRSNPEPTGYDWSTTSGTFPTSAVAQGSQLVIHAVDSLFNTTFVCTVTNAVGMGRAEQVIFVRETPNTAGAGATGG

SEQ ID NO: 1436 - protein, 329 aa, synthetic construct
  REGION 1..329: note = CD112 v69 ECD
QDVRVQVLPEVRGQLGGTVELPCHLLPPVPGLHISLVTWQRPDAPANHQNVAAFHPKMGPSFPSPKPGSERLSFVSAKRSTGQDTEAELQDATLALHGLTVEDEGIYTCEFVTFPKGTVRGMTWLRVIAKPKNQAEAQKVTFSQDPTTVALCISKEGRPPARISWLSSLDWEAKETQVSGTLAGTVTVTSRFTLVPSGRADGVTVTCKVEHESFEEPALIPVTLSVRYPPEVSISGYDDNWYLGRTDATLSCDVRSNPEPTGYDWSTTSGTFPTSAVAQGSQLVIHAVDSLFNTTFVCTVTNAVGMGRAEQVIFVRETPNTAGAGATGG

SEQ ID NO: 1437 - protein, 329 aa, synthetic construct
  REGION 1..329: note = CD112 v70 ECD
QDVRVQVLPEVRGQLGGTVELPCHLLPPVPGLYISLVTWQRPDAPANHQNVAAFHPKMGPSFPSPKPGSERLSFVSAKRSTGQDTEAELQDATLALHGLTVEDEGNYTCEFVTFPKGSVRGMTWLRVIAKPKNQAEAQKVTFSQDPTTVALCISKEGRPPARISWLSSLDWEAKETQVSGTLAGTVTVTSRFTLVPSGRADGVTVTCKVEHESFEEPALIPVTLSVRYPPEVSISGYDDNWYLGRTDATLSCDVRSNPEPTGYDWSTTSGTFPTSAVAQGSQLVIHAVDSLFNTTFVCTVTNAVGMGRAEQVIFVRETPNTAGAGATGG

SEQ ID NO: 1438 - protein, 329 aa, synthetic construct
  REGION 1..329: note = CD112 v71 ECD
QDVRVQVLPEVRGQLGGTVELPCHLLPPVPGLHISLVTWQRPDAPTNHQNVAAFHPKMGPSFPSPKPGSERLSFVSAKRSTGQDTEAELQDATLALHGLTVEDEGIYTCEFATFPKGFVRGMTWLRVIAKPKNQAEAQKVTFSQDPTTVALCISKEGRPPARISWLSSLDWEAKETQVSGTLAGTVTVTSRFTLVPSGRADGVTVTCKVEHESFEEPALIPVTLSVRYPPEVSISGYDDNWYLGRTDATLSCDVRSNPEPTGYDWSTTSGTFPTSAVAQGSQLVIHAVDSLFNTTFVCTVTNAVGMGRAEQVIFVRETPNTAGAGATGG

SEQ ID NO: 1439 - protein, 329 aa, synthetic construct
  REGION 1..329: note = CD112 v72 ECD
QDVRVQVLPEVRGQLGGTVELPCHLLPPVPGLYISLVTWQRPDAPANHQNVAAFHPKMGPSFPSPKPGSERLSFVSAKQSTGQDTEAELQDATLALHGLTVEDEGNYTCEFVTFPKGSVRSMTWLRVIAKPKNQAEAQKVTFSQDPTTVALCISKEGRPPARISWLSSLDWEAKETQVSGTLAGTVTVTSRFTLVPSGRADGVTVTCKVEHESFEEPALIPVTLSVRYPPEVSISGYDDNWYLGRTDATLSCDVRSNPEPTGYDWSTTSGTFPTSAVAQGSQLVIHAVDSLFNTTFVCTVTNAVGMGRAEQVIFVRETPNTAGAGATGG

SEQ ID NO: 1440 - protein, 329 aa, synthetic construct
  REGION 1..329: note = CD112 v73 ECD
QDVRVQVLPEVRGQLGGTVELPCHLLPPVPGLHISLVTWQRPDAPANHQNVAAFHPKMGPSFPSPKPGSERLSFVSAKRSTGQDTEAELQDATLALHGLTVEDEGIYTCEFATFPKGYVRGMTWLRVIAKPKNQAEAQKVTFSQDPTTVALCISKEGRPPARISWLSSLDWEAKETQVSGTLAGTVTVTSRFTLVPSGRADGVTVTCKVEHESFEEPALIPVTLSVRYPPEVSISGYDDNWYLGRTDATLSCDVRSNPEPTGYDWSTTSGTFPTSAVAQGSQLVIHAVDSLFNTTFVCTVTNAVGMGRAEQVIFVRETPNTAGAGATGG

SEQ ID NO: 1441 - protein, 329 aa, synthetic construct
  REGION 1..329: note = CD112 v74 ECD
QDVRVQVLPEVRGQLGGTVELPCHLLPPVPGLHISLVTWQRPDAPANHQNVAAFHPKMGPSFPSPKPGSERLSFVSAKQSTGQDTEAELQDATLALHGLTVEDEGIYTCEFVTFPKGSVRGMTWLRVIAKPKNQAEAQKVTFSQDPTTVALCISKEGRPPARISWLSSLDWEAKETQVSGTLAGTVTVTSRFTLVPSGRADGVTVTCKVEHESFEEPALIPVTLSVRYPPEVSISGYDDNWYLGRTDATLSCDVRSNPEPTGYDWSTTSGTFPTSAVAQGSQLVIHAVDSLFNTTFVCTVTNAVGMGRAEQVIFVRETPNTAGAGATGG

SEQ ID NO: 1442 - protein, 329 aa, synthetic construct
  REGION 1..329: note = CD112 v75 ECD
QDVRVQVLPEVRGQLGGTVELPCHLLPPVPGLHISLVTWQRPDAPTNHQNVAAFHPKMGPSFPSPKPGSERLSFVSAKQSTGQDTEAELQDATLALHGLTMEDEGNYTCEFVTFPKGTVRGMTWLRVIAKPKNQAEAQKVTFSQDPTTVALCISKEGRPPARISWLSSLDWEAKETQVSGTLAGTVTVTSRFTLVPSGRADGVTVTCKVEHESFEEPALIPVTLSVRYPPEVSISGYDDNWYLGRTDATLSCDVRSNPEPTGYDWSTTSGTFPTSAVAQGSQLVIHAVDSLFNTTFVCTVTNAVGMGRAEQVIFVRETPNTAGAGATGG

SEQ ID NO: 1443 - protein, 329 aa, synthetic construct
  REGION 1..329: note = CD112 v76 ECD
QDVRVQVLPEVRGQLGGTVELPCHLLPPVPGPYISLVTWQRPDAPANHQNVAAFHPKMGPSFPSPKPGSERLSFVSAKQSTGQDTEAELQDATLALHGMTVEDEGIYTCEFATFPKGFVRGMTWLRVIAKPKNQAEAQKVTFSQDPTTVALCISKEGRPPARISWLSSLDWEAKETQVSGTLAGTVTVTSRFTLVPSGRADGVTVTCKVEHESFEEPALIPVTLSVRYPPEVSISGYDDNWYLGRTDATLSCDVRSNPEPTGYDWSTTSGTFPTSAVAQGSQLVIHAVDSLFNTTFVCTVTNAVGMGRAEQVIFVRETPNTAGAGATGG

SEQ ID NO: 1444 - protein, 329 aa, synthetic construct
  REGION 1..329: note = CD112 v77 ECD
QDVRVQVLPEVRGQLGGTVELPCHLLPPVPGPYISLVTWQRPDAPANHQNVAAFHPKMGPSFPSPKPGSERLSFVSAKQSTGQDTEAELQDATLALHGLTVEDEGNYACEFATFPKGFVRGMTWLRVIAKPKNQAEAQKVTFSQDPTTVALCISKEGRPPARISWLSSLDWEAKETQVSGTLAGTVTVTSRFTLVPSGRADGVTVTCKVEHESFEEPALIPVTLSVRYPPEVSISGYDDNWYLGRTDATLSCDVRSNPEPTGYDWSTTSGTFPTSAVAQGSQLVIHAVDSLFNTTFVCTVTNAVGMGRAEQVIFVRETPNTAGAGATGG

SEQ ID NO: 1445 - protein, 329 aa, synthetic construct
  REGION 1..329: note = CD112 v78 ECD
QDVRVQVLPEVWGQLGGTVELPCHLLPPVPGLYISLVTWQRPDAPANHQNVAAFHPKMGPSFPSPKPGSERLSFVSAKRSTGQDTEAELQDATLALHGLTVEDEGNYTCEFVTFPKGSVRGMTWLRVIAKPKNQAEAQKVTFSQDPTTVALCISKEGRPPARISWLSSLDWEAKETQVSGTLAGTVTVTSRFTLVPSGRADGVTVTCKVEHESFEEPALIPVTLSVRYPPEVSISGYDDNWYLGRTDATLSCDVRSNPEPTGYDWSTTSGTFPTSAVAQGSQLVIHAVDSLFNTTFVCTVTNAVGMGRAEQVIFVRETPNTAGAGATGG

SEQ ID NO: 1446 - protein, 329 aa, synthetic construct
  REGION 1..329: note = CD112 v79 ECD
QDVRVQVLPEVRGQLGGTVELPCHLLPPVPGLHISLVTWQRPDAPANHQNVAAFHPKMGPSFPSPKPGSERLSFVSAKQSTGQDTEAELQDATLALHGLTVEDEGYYTCGFVTFPKGSVRGMTWLRVIAKPKNQAEAQKVTFSQDPTTVALCISKEGRPPARISWLSSLDWEAKETQVSGTLAGTVTVTSRFTLVPSGRADGVTVTCKVEHESFEEPALIPVTLSVRYPPEVSISGYDDNWYLGRTDATLSCDVRSNPEPTGYDWSTTSGTFPTSAVAQGSQLVIHAVDSLFNTTFVCTVTNAVGMGRAEQVIFVRETPNTAGAGATGG

SEQ ID NO: 1447 - protein, 329 aa, synthetic construct
  REGION 1..329: note = CD112 v80 ECD
QDVRVQVLPEVRGQLGGTVELPCHLLPPVPGLHISLVTWQRPDAPANHQNVAAFHPKMGPSFPSPKPGSERLSFVSAKQSTGQDTEAELQDATLALHGLTVEDEGIYTCEFATFPKGYVRGMTWLRVIAKPKNQAEAQKVTFSQDPTTVALCISKEGRPPARISWLSSLDWEAKETQVSGTLAGTVTVTSRFTLVPSGRADGVTVTCKVEHESFEEPALIPVTLSVRYPPEVSISGYDDNWYLGRTDATLSCDVRSNPEPTGYDWSTTSGTFPTSAVAQGSQLVIHAVDSLFNTTFVCTVTNAVGMGRAEQVIFVRETPNTAGAGATGG

SEQ ID NO: 1448 - protein, 329 aa, synthetic construct
  REGION 1..329: note = CD112 v81 ECD
QDVRVQVLPEVRGQLGGTVELPCHLLPPVPGLYISLVTWQRPDAPANHQNVAAFHPKMGPSFPSPKPGSERLSFVSAKRSTGQDTEAELQDATLALHGLTVEDEGNYTCEFATFPKGFVRGMTWLRVIAKPKNQAEAQKVTFSQDPTTVALCISKEGRPPARISWLSSLDWEAKETQVSGTLAGTVTVTSRFTLVPSGRADGVTVTCKVEHESFEEPALIPVTLSVRYPPEVSISGYDDNWYLGRTDATLSCDVRSNPEPTGYDWSTTSGTFPTSAVAQGSQLVIHAVDSLFNTTFVCTVTNAVGMGRAEQVIFVRETPNTAGAGATGG

SEQ ID NO: 1449 - protein, 329 aa, synthetic construct
  REGION 1..329: note = CD112 v82 ECD
QDVRVQVLPEVRGQLGGTVELPCHLLPPVPGLHISLVTWQRPDAPANHQNVAAFHPKMGPSFPSPKPGSERLSFVSAKRSTGQDTEAELQDATLALHDLTMEDEGNYTCEFVTFPKGSVRGMTWLRVIAKPKNQAEAQKVTFSQDPTTVALCISKEGRPPARISWLSSLDWEAKETQVSGTLAGTVTVTSRFTLVPSGRADGVTVTCKVEHESFEEPALIPVTLSVRYPPEVSISGYDDNWYLGRTDATLSCDVRSNPEPTGYDWSTTSGTFPTSAVAQGSQLVIHAVDSLFNTTFVCTVTNAVGMGRAEQVIFVRETPNTAGAGATGG

SEQ ID NO: 1450 - protein, 329 aa, synthetic construct
  REGION 1..329: note = CD112 v83 ECD
QDVRVQVLPEVRGQLGGTVELPCHLLPPVPGLYISLVTWQRPDAPAKHQNVAAFHPKMGPSFPSPKPGSERLSFVSAKQSSGQDTEAELQDATLALHGLTMEDEGNYTCEFVTFPKGFVRGMTWLRVIAKPKNQAEAQKVTFSQDPTTVALCISKEGRPPARISWLSSLDWEAKETQVSGTLAGTVTVTSRFTLVPSGRADGVTVTCKVEHESFEEPALIPVTLSVRYPPEVSISGYDDNWYLGRTDATLSCDVRSNPEPTGYDWSTTSGTFPTSAVAQGSQLVIHAVDSLFNTTFVCTVTNAVGMGRAEQVIFVRETPNTAGAGATGG

SEQ ID NO: 1451 - protein, 329 aa, synthetic construct
  REGION 1..329: note = CD112 v84 ECD
QDVRVQVLPEVRGQLGGTVELPCHLLPPVPGLYISLVTWQRPDAPANHQNVAAFHPKMGPSFPSPKPGSERLSFVSAKQSTSQDTEAELQDATLALHGLTVEDEGNYTCEFATFPKGYVRGMTWLRVIAKPKNQAEAQKVTFSQDPTTVALCISKEGRPPARISWLSSLDWEAKETQVSGTLAGTVTVTSRFTLVPSGRADGVTVTCKVEHESFEEPALIPVTLSVRYPPEVSISGYDDNWYLGRTDATLSCDVRSNPEPTGYDWSTTSGTFPTSAVAQGSQLVIHAVDSLFNTTFVCTVTNAVGMGRAEQVIFVRETPNTAGAGATGG

SEQ ID NO: 1452 - protein, 329 aa, synthetic construct
  REGION 1..329: note = CD112 v85 ECD
QDVRVQVLPEVRGQLGGTVELPCHLLPPVPGLHISLVTWQRPDAPANHQNVAAFHPKMGPSFPSPKPGSERLSFVSAKQSTGQDTEAELQDATLALHGLTVEDEGNYTCEFVTFPKGYVRGMTWLRVIAKPKNQAEAQKVTFSQDPTTVALCISKEGRPPARISWLSSLDWEAKETQVSGTLAGTVTVTSRFTLVPSGRADGVTVTCKVEHESFEEPALIPVTLSVRYPPEVSISGYDDNWYLGRTDATLSCDVRSNPEPTGYDWSTTSGTFPTSAVAQGSQLVIHAVDSLFNTTFVCTVTNAVGMGRAEQVIFVRETPNTAGAGATGG

SEQ ID NO: 1453 - protein, 329 aa, synthetic construct
  REGION 1..329: note = CD112 v86 ECD
QDVRVQVLPEVRGQLGGTVELPCHLLPPVPGLHISLVTWQRPDAPAKHQNVAAFHPKMGPSFPSPKPGSERLSFVSAKRSTGQDTEAELQDATLALHGLTVEDEGYYTCEFVTFPKGSVRGMTWLRVIAKPKNQAEAQKVTFSQDPTTVALCISKEGRPPARISWLSSLDWEAKETQVSGTLAGTVTVTSRFTLVPSGRADGVTVTCKVEHESFEEPALIPVTLSVRYPPEVSISGYDDNWYLGRTDATLSCDVRSNPEPTGYDWSTTSGTFPTSAVAQGSQLVIHAVDSLFNTTFVCTVTNAVGMGRAEQVIFVRETPNTAGAGATGG

SEQ ID NO: 1454 - protein, 329 aa, synthetic construct
  REGION 1..329: note = CD112 v87 ECD
QDVRVQVLPEVRGQLGGTVELPCHLLPPVPGLHISLVTWQRPDAPANHQNVAAFHPKMGPSFPSPKPGSERLSFVSAKQSTGQDTEAELQDATLALHGLTVEDEGNYTCEFATFPKGTVRGMTWLRVIAKPKNQAEAQKVTFSQDPTTVALCISKEGRPPARISWLSSLDWEAKETQVSGTLAGTVTVTSRFTLVPSGRADGVTVTCKVEHESFEEPALIPVTLSVRYPPEVSISGYDDNWYLGRTDATLSCDVRSNPEPTGYDWSTTSGTFPTSAVAQGSQLVIHAVDSLFNTTFVCTVTNAVGMGRAEQVIFVRETPNTAGAGATGG

SEQ ID NO: 1455 - protein, 329 aa, synthetic construct
  REGION 1..329: note = CD112 v88 ECD
QDVRVQVLPEVWGQLGGTVELPCHLLPPVPGLHISLVTWQRPDAPANHQNVAAFHPKMGPSFPSPKPGSERLSFVSAKRSTGQDTEAELQDATLALHGLTMEDEGNYTCEFVTFPKGSVRGMTWLRVIAKPKNQAEAQKVTFSQDPTTVALCISKEGRPPARISWLSSLDWEAKETQVSGTLAGTVTVTSRFTLVPSGRADGVTVTCKVEHESFEEPALIPVTLSVRYPPEVSISGYDDNWYLGRTDATLSCDVRSNPEPTGYDWSTTSGTFPTSAVAQGSQLVIHAVDSLFNTTFVCTVTNAVGMGRAEQVIFVRETPNTAGAGATGG

SEQ ID NO: 1456 - protein, 125 aa, synthetic construct
  REGION 1..125: note = CD112 v48 IgV
QDVRVQVLPEVRGQLGGTVELPCHLLPPVPGLYISLVTWQRPDAPAKHQNVAAFHPKMGPSFPSPKPGSERLSFVSAKRSTGQDTEAELQDATLALHGLTVEDEGNYTCEFATFPKGFVRGMTWL

SEQ ID NO: 1457 - protein, 125 aa, synthetic construct
  REGION 1..125: note = CD112 v49 IgV
QDVRVQVLPEVRGQLGGTVELPCHLLPPVPGLYISLVTWRRPDAPANHQNVAAFHPKMGTSFPSPKPGSERLSFVSAKQSTGQDTEAELQDATLALHGLTVEDEGNYTCEFVTFPKGTVRGMTWL

SEQ ID NO: 1458 - protein, 125 aa, synthetic construct
  REGION 1..125: note = CD112 v50 IgV
QDVRVQVLPEVRGQLGGTVELPCHLLPPVPGLYISLVTWQRPDAPANHQNVAAFHPKMGPSFPSPKPGSERLSFVSAKQSTGQDTEAELQDATLALHGLTVEDEGNYTCEFATYPKGFVRGMTWL

SEQ ID NO: 1459 - protein, 125 aa, synthetic construct
  REGION 1..125: note = CD112 v51 IgV
QDVRVQVLPEVRGQLGGTVELPCHLLPPVPGLHISLVTWQRPDAPANHQNVAAFHPKMGPSFPSPKPGSERLSFVSARQSTGQDTEAELQDATLALHGLTVEDEGNYTCEFATFPKGYVRGMTWL

SEQ ID NO: 1460 - protein, 125 aa, synthetic construct
  REGION 1..125: note = CD112 v52 IgV
QDVRVQVLPEVWGQLGGTVELPCHLLPPVPGLYISLVTWQRPDAPTNHQNVAAFHPKMGPSFPSPMPGSERLSFVSAKRSTGQDTEAELQDATLALHGLTVEDEGIYTCEFAAFPKGFVRGMTWL

SEQ ID NO: 1461 - protein, 125 aa, synthetic construct
  REGION 1..125: note = CD112 v53 IgV
QDVRVQVLPEVRGQLGGTVELPCHLLPPVPGLHISLVTWQRPDAPANHQNVAAFHPKMGPSFPSPKPGSERLSFVSAKQSTGQDTEAELQDATLALHGLTVEDEGNYTCEFVTFPKGFVRGMTWL

SEQ ID NO: 1462 - protein, 125 aa, synthetic construct
  REGION 1..125: note = CD112 v54 IgV
QDVRVQVLPEVWGQLGGTVELPCHLLPPVPGLHISLVTWQRPDAPANHQNVAAFHPKMGPSFPSPKPGSERLSFVSAKQSTGQDTEAELQDATLALHGLTVEDEGIYTCEFATFPKGFVRGMTWL

SEQ ID NO: 1463 - protein, 125 aa, synthetic construct
  REGION 1..125: note = CD112 v55 IgV
QDVRVQVLPEVRGQVGGTVELPCHLLPPVPGLYISLVTWQRPDAPANHQNVAAFHPKMGPSFPSPKPGSERLSFVSAKQSTGQDTEAELRDATLALHGLTVEDEGNYTCEFATFPKGFVRGMTWL

SEQ ID NO: 1464 - protein, 125 aa, synthetic construct
  REGION 1..125: note = CD112 v56 IgV
QDVRVQVLPEVRGQLGGTVELPCHLLPPVPGLYISLVTWQRPDAPAKHQNVAAFHPKMGPSFPSPKPGSERLSFVSAKQSTGQGTEAELQDATLALHGLTVEDEGIYTCEFATFPKGYVRGMTWL

SEQ ID NO: 1465 - protein, 125 aa, synthetic construct
  REGION 1..125: note = CD112 v57 IgV
QDVRVQVLPEVRGQLGGTVELPCHLLPPVPGPYISLVTWQRPDAPANHQNVAAFHPKMGPSFPSPKPGSERLSFVSAKQSTGQDTEAELQDATLALHGLTVEDEGNYTCEFATFPKGFVRGMTWL

SEQ ID NO: 1466 - protein, 125 aa, synthetic construct
  REGION 1..125: note = CD112 v58 IgV
QDVRVQVLPEVRGQLGGTVELPCHLLPPVPGLHISLVTWQRPDAPANHQNVAAFHPKMGPSFPSPKPGSERLSFVSAKRSTGQDTEAELQDATLALHGLTVEDEGNYTCEFVTFPKGYVRGMTWL

SEQ ID NO: 1467 - protein, 125 aa, synthetic construct
  REGION 1..125: note = CD112 v59 IgV
QDVRVQVLPEVRGQLGGAVELPCHLLPPVPGLYISLVTWQRPDAPANHQNVAAFHPKMGPSFPSPKPGSERLSFVSAKQSTGQDTEAELQDATLALHGLTVEDEGIYTCEFATFPKGTVRGMTWL

SEQ ID NO: 1468 - protein, 125 aa, synthetic construct
  REGION 1..125: note = CD112 v60 IgV
QDVRVQVLPEVRGQVGGTVELPCHLLPPVPGLHISLVTWQRPDAPANHQNVAAFHPKMGPSFPSPKPGSERLSFVSAKQSTGQDTEAELQDATLALHGLTVEDEGYYTCEFVTFPKGFVRGMTWL

SEQ ID NO: 1469 - protein, 125 aa, synthetic construct
  REGION 1..125: note = CD112 v61 IgV
QDVRVQVLPEVRGQLGGTVELPCHLLPPVPGLYISLMTWQRPDAPANHQNVAAFHPKMGPSFPSPKPGSERLSFVSAKQSTGQDTEAELQDATLALHGLTVEDEGNYTCEFATFPKGFVRGMTWL

SEQ ID NO: 1470 - protein, 125 aa, synthetic construct
  REGION 1..125: note = CD112 v62 IgV
QDVRVQVLPEVRGQLGGTVELPCHLLPPVPGLYISLVTWQRPDAPAKHQNVAAFHPKMGPSFPSPKPGSERLSFVSAKQSTGQDTEAELQDATLALHGLTVEDEGNYTCEFVTFPKGYVRGMTWL

SEQ ID NO: 1471 - protein, 125 aa, synthetic construct
  REGION 1..125: note = CD112 v63 IgV
QDVRVQVLPEVRGQLGGTVELPCHLLPPVPGLYISLVTWQRPDAPTNHQNVAAFHPKMGPSFPSPKPGSERLSFVSAKQSTGQDTEAELQDATLALHGLTVEDEGNYTCEFVTFPKGSVRGMTWL

SEQ ID NO: 1472 - protein, 125 aa, synthetic construct
  REGION 1..125: note = CD112 v64 IgV
QDVRVQVLPEVRGQLGGTVELPCHLLPSVPGLHISLVTWQRPDAPANHQNVAAFHPKMGPSFPSPKPGSERLSFVSAKQSTGQDTEAELQDATLALHGLTVEDEGIYTCEFATFPKGYVRGMTWL

SEQ ID NO: 1473 - protein, 125 aa, synthetic construct
  REGION 1..125: note = CD112 v65 IgV
QDVRVQVLPEVRGQLGGTVELPCHLLPPVSGLHISLVTWQRPDAPAKHQNVAAFHPKMGPSFPSPKPGSERLSFMSAKRSTGQDTEAELQDATLALHGLTVEDEGIYTCEFATFPKGYVRGMTWL

SEQ ID NO: 1474 - protein, 125 aa, synthetic construct
  REGION 1..125: note = CD112 v66 IgV
QDVRVQVLPEVRGQLGGTAELPCHLLPPVPGLYISLVTWQRPDAPAKHQNVAAFHPKMGPSFPSPKPGSERLSFVSAKQSTGQDTEAELQDATLALHGLTVEDEGYYTCEFATFPEGYVRGMTWL

SEQ ID NO: 1475 - protein, 125 aa, synthetic construct
  REGION 1..125: note = CD112 v67 IgV
QDVRVQVLPEVRGQLGGTVELPCHLLPPVPGLYISLVTWQRPDAPANHQNVAAFHPKMGPSFPSPKPGSERLSFVSAKRSTGQDAEAELQDATLALHGLTVEDEGNYTCEFVTFPKGYVRGMTWL

SEQ ID NO: 1476 - protein, 125 aa, synthetic construct
  REGION 1..125: note = CD112 v68 IgV
QDVRVQVLPEVRGQLGGTVELPCHLLPPVPGLYISLVTWQRPDAPANHQNVAAFHPKMGPSFPSPKPGSERLSFVSAKQSTGQDTEAELQDATLALHGLTMEDEGIYTCEFATFPKGYVRGMTWL

SEQ ID NO: 1477 - protein, 125 aa, synthetic construct
  REGION 1..125: note = CD112 v69 IgV
QDVRVQVLPEVRGQLGGTVELPCHLLPPVPGLHISLVTWQRPDAPANHQNVAAFHPKMGPSFPSPKPGSERLSFVSAKRSTGQDTEAELQDATLALHGLTVEDEGIYTCEFVTFPKGTVRGMTWL

SEQ ID NO: 1478 - protein, 125 aa, synthetic construct
  REGION 1..125: note = CD112 v70 IgV
QDVRVQVLPEVRGQLGGTVELPCHLLPPVPGLYISLVTWQRPDAPANHQNVAAFHPKMGPSFPSPKPGSERLSFVSAKRSTGQDTEAELQDATLALHGLTVEDEGNYTCEFVTFPKGSVRGMTWL

SEQ ID NO: 1479 - protein, 125 aa, synthetic construct
  REGION 1..125: note = CD112 v71 IgV
QDVRVQVLPEVRGQLGGTVELPCHLLPPVPGLHISLVTWQRPDAPTNHQNVAAFHPKMGPSFPSPKPGSERLSFVSAKRSTGQDTEAELQDATLALHGLTVEDEGIYTCEFATFPKGFVRGMTWL

SEQ ID NO: 1480 - protein, 125 aa, synthetic construct
  REGION 1..125: note = CD112 v72 IgV
QDVRVQVLPEVRGQLGGTVELPCHLLPPVPGLYISLVTWQRPDAPANHQNVAAFHPKMGPSFPSPKPGSERLSFVSAKQSTGQDTEAELQDATLALHGLTVEDEGNYTCEFVTFPKGSVRSMTWL

SEQ ID NO: 1481 - protein, 125 aa, synthetic construct
  REGION 1..125: note = CD112 v73 IgV
QDVRVQVLPEVRGQLGGTVELPCHLLPPVPGLHISLVTWQRPDAPANHQNVAAFHPKMGPSFPSPKPGSERLSFVSAKRSTGQDTEAELQDATLALHGLTVEDEGIYTCEFATFPKGYVRGMTWL

SEQ ID NO: 1482 - protein, 125 aa, synthetic construct
  REGION 1..125: note = CD112 v74 IgV
QDVRVQVLPEVRGQLGGTVELPCHLLPPVPGLHISLVTWQRPDAPANHQNVAAFHPKMGPSFPSPKPGSERLSFVSAKQSTGQDTEAELQDATLALHGLTVEDEGIYTCEFVTFPKGSVRGMTWL

SEQ ID NO: 1483 - protein, 125 aa, synthetic construct
  REGION 1..125: note = CD112 v75 IgV
QDVRVQVLPEVRGQLGGTVELPCHLLPPVPGLHISLVTWQRPDAPTNHQNVAAFHPKMGPSFPSPKPGSERLSFVSAKQSTGQDTEAELQDATLALHGLTMEDEGNYTCEFVTFPKGTVRGMTWL

SEQ ID NO: 1484 - protein, 125 aa, synthetic construct
  REGION 1..125: note = CD112 v76 IgV
QDVRVQVLPEVRGQLGGTVELPCHLLPPVPGPYISLVTWQRPDAPANHQNVAAFHPKMGPSFPSPKPGSERLSFVSAKQSTGQDTEAELQDATLALHGMTVEDEGIYTCEFATFPKGFVRGMTWL

SEQ ID NO: 1485 - protein, 125 aa, synthetic construct
  REGION 1..125: note = CD112 v77 IgV
QDVRVQVLPEVRGQLGGTVELPCHLLPPVPGPYISLVTWQRPDAPANHQNVAAFHPKMGPSFPSPKPGSERLSFVSAKQSTGQDTEAELQDATLALHGLTVEDEGNYACEFATFPKGFVRGMTWL

SEQ ID NO: 1486 - protein, 125 aa, synthetic construct
  REGION 1..125: note = CD112 v78 IgV
QDVRVQVLPEVWGQLGGTVELPCHLLPPVPGLYISLVTWQRPDAPANHQNVAAFHPKMGPSFPSPKPGSERLSFVSAKRSTGQDTEAELQDATLALHGLTVEDEGNYTCEFVTFPKGSVRGMTWL

SEQ ID NO: 1487 - protein, 125 aa, synthetic construct
  REGION 1..125: note = CD112 v79 IgV
QDVRVQVLPEVRGQLGGTVELPCHLLPPVPGLHISLVTWQRPDAPANHQNVAAFHPKMGPSFPSPKPGSERLSFVSAKQSTGQDTEAELQDATLALHGLTVEDEGYYTCGFVTFPKGSVRGMTWL

SEQ ID NO: 1488 - protein, 125 aa, synthetic construct
  REGION 1..125: note = CD112 v80 IgV
QDVRVQVLPEVRGQLGGTVELPCHLLPPVPGLHISLVTWQRPDAPANHQNVAAFHPKMGPSFPSPKPGSERLSFVSAKQSTGQDTEAELQDATLALHGLTVEDEGIYTCEFATFPKGYVRGMTWL

SEQ ID NO: 1489 - protein, 125 aa, synthetic construct
  REGION 1..125: note = CD112 v81 IgV
QDVRVQVLPEVRGQLGGTVELPCHLLPPVPGLYISLVTWQRPDAPANHQNVAAFHPKMGPSFPSPKPGSERLSFVSAKRSTGQDTEAELQDATLALHGLTVEDEGNYTCEFATFPKGFVRGMTWL

SEQ ID NO: 1490 - protein, 125 aa, synthetic construct
  REGION 1..125: note = CD112 v82 IgV
QDVRVQVLPEVRGQLGGTVELPCHLLPPVPGLHISLVTWQRPDAPANHQNVAAFHPKMGPSFPSPKPGSERLSFVSAKRSTGQDTEAELQDATLALHDLTMEDEGNYTCEFVTFPKGSVRGMTWL

SEQ ID NO: 1491 - protein, 125 aa, synthetic construct
  REGION 1..125: note = CD112 v83 IgV
QDVRVQVLPEVRGQLGGTVELPCHLLPPVPGLYISLVTWQRPDAPAKHQNVAAFHPKMGPSFPSPKPGSERLSFVSAKQSSGQDTEAELQDATLALHGLTMEDEGNYTCEFVTFPKGFVRGMTWL

SEQ ID NO: 1492 - protein, 125 aa, synthetic construct
  REGION 1..125: note = CD112 v84 IgV
QDVRVQVLPEVRGQLGGTVELPCHLLPPVPGLYISLVTWQRPDAPANHQNVAAFHPKMGPSFPSPKPGSERLSFVSAKQSTSQDTEAELQDATLALHGLTVEDEGNYTCEFATFPKGYVRGMTWL

SEQ ID NO: 1493 - protein, 125 aa, synthetic construct
  REGION 1..125: note = CD112 v85 IgV
QDVRVQVLPEVRGQLGGTVELPCHLLPPVPGLHISLVTWQRPDAPANHQNVAAFHPKMGPSFPSPKPGSERLSFVSAKQSTGQDTEAELQDATLALHGLTVEDEGNYTCEFVTFPKGYVRGMTWL

SEQ ID NO: 1494 - protein, 125 aa, synthetic construct
  REGION 1..125: note = CD112 v86 IgV
QDVRVQVLPEVRGQLGGTVELPCHLLPPVPGLHISLVTWQRPDAPAKHQNVAAFHPKMGPSFPSPKPGSERLSFVSAKRSTGQDTEAELQDATLALHGLTVEDEGYYTCEFVTFPKGSVRGMTWL

SEQ ID NO: 1495 - protein, 125 aa, synthetic construct
  REGION 1..125: note = CD112 v87 IgV
QDVRVQVLPEVRGQLGGTVELPCHLLPPVPGLHISLVTWQRPDAPANHQNVAAFHPKMGPSFPSPKPGSERLSFVSAKQSTGQDTEAELQDATLALHGLTVEDEGNYTCEFATFPKGTVRGMTWL

SEQ ID NO: 1496 - protein, 125 aa, synthetic construct
  REGION 1..125: note = CD112 v88 IgV
QDVRVQVLPEVWGQLGGTVELPCHLLPPVPGLHISLVTWQRPDAPANHQNVAAFHPKMGPSFPSPKPGSERLSFVSAKRSTGQDTEAELQDATLALHGLTMEDEGNYTCEFVTFPKGSVRGMTWL

SEQ ID NO: 1497 - protein, 127 aa, synthetic construct
  REGION 1..127: note = CD112 v48 IgV
QDVRVQVLPEVRGQLGGTVELPCHLLPPVPGLYISLVTWQRPDAPAKHQNVAAFHPKMGPSFPSPKPGSERLSFVSAKRSTGQDTEAELQDATLALHGLTVEDEGNYTCEFATFPKGFVRGMTWLRV

SEQ ID NO: 1498 - protein, 127 aa, synthetic construct
  REGION 1..127: note = CD112 v49 IgV
QDVRVQVLPEVRGQLGGTVELPCHLLPPVPGLYISLVTWRRPDAPANHQNVAAFHPKMGTSFPSPKPGSERLSFVSAKQSTGQDTEAELQDATLALHGLTVEDEGNYTCEFVTFPKGTVRGMTWLRV

SEQ ID NO: 1499 - protein, 127 aa, synthetic construct
  REGION 1..127: note = CD112 v50 IgV
QDVRVQVLPEVRGQLGGTVELPCHLLPPVPGLYISLVTWQRPDAPANHQNVAAFHPKMGPSFPSPKPGSERLSFVSAKQSTGQDTEAELQDATLALHGLTVEDEGNYTCEFATYPKGFVRGMTWLRV

SEQ ID NO: 1500 - protein, 127 aa, synthetic construct
  REGION 1..127: note = CD112 v51 IgV
QDVRVQVLPEVRGQLGGTVELPCHLLPPVPGLHISLVTWQRPDAPANHQNVAAFHPKMGPSFPSPKPGSERLSFVSARQSTGQDTEAELQDATLALHGLTVEDEGNYTCEFATFPKGYVRGMTWLRV

SEQ ID NO: 1501 - protein, 127 aa, synthetic construct
  REGION 1..127: note = CD112 v52 IgV
QDVRVQVLPEVWGQLGGTVELPCHLLPPVPGLYISLVTWQRPDAPTNHQNVAAFHPKMGPSFPSPMPGSERLSFVSAKRSTGQDTEAELQDATLALHGLTVEDEGIYTCEFAAFPKGFVRGMTWLRV

SEQ ID NO: 1502 - protein, 127 aa, synthetic construct
  REGION 1..127: note = CD112 v53 IgV
QDVRVQVLPEVRGQLGGTVELPCHLLPPVPGLHISLVTWQRPDAPANHQNVAAFHPKMGPSFPSPKPGSERLSFVSAKQSTGQDTEAELQDATLALHGLTVEDEGNYTCEFVTFPKGFVRGMTWLRV

SEQ ID NO: 1503 - protein, 127 aa, synthetic construct
  REGION 1..127: note = CD112 v54 IgV
QDVRVQVLPEVWGQLGGTVELPCHLLPPVPGLHISLVTWQRPDAPANHQNVAAFHPKMGPSFPSPKPGSERLSFVSAKQSTGQDTEAELQDATLALHGLTVEDEGIYTCEFATFPKGFVRGMTWLRV

SEQ ID NO: 1504 - protein, 127 aa, synthetic construct
  REGION 1..127: note = CD112 v55 IgV
QDVRVQVLPEVRGQVGGTVELPCHLLPPVPGLYISLVTWQRPDAPANHQNVAAFHPKMGPSFPSPKPGSERLSFVSAKQSTGQDTEAELRDATLALHGLTVEDEGNYTCEFATFPKGFVRGMTWLRV

SEQ ID NO: 1505 - protein, 127 aa, synthetic construct
  REGION 1..127: note = CD112 v56 IgV
QDVRVQVLPEVRGQLGGTVELPCHLLPPVPGLYISLVTWQRPDAPAKHQNVAAFHPKMGPSFPSPKPGSERLSFVSAKQSTGQGTEAELQDATLALHGLTVEDEGIYTCEFATFPKGYVRGMTWLRV

SEQ ID NO: 1506 - protein, 127 aa, synthetic construct
  REGION 1..127: note = CD112 v57 IgV
QDVRVQVLPEVRGQLGGTVELPCHLLPPVPGPYISLVTWQRPDAPANHQNVAAFHPKMGPSFPSPKPGSERLSFVSAKQSTGQDTEAELQDATLALHGLTVEDEGNYTCEFATFPKGFVRGMTWLRV

SEQ ID NO: 1507 - protein, 127 aa, synthetic construct
  REGION 1..127: note = CD112 v58 IgV
QDVRVQVLPEVRGQLGGTVELPCHLLPPVPGLHISLVTWQRPDAPANHQNVAAFHPKMGPSFPSPKPGSERLSFVSAKRSTGQDTEAELQDATLALHGLTVEDEGNYTCEFVTFPKGYVRGMTWLRV

SEQ ID NO: 1508 - protein, 127 aa, synthetic construct
  REGION 1..127: note = CD112 v59 IgV
QDVRVQVLPEVRGQLGGAVELPCHLLPPVPGLYISLVTWQRPDAPANHQNVAAFHPKMGPSFPSPKPGSERLSFVSAKQSTGQDTEAELQDATLALHGLTVEDEGIYTCEFATFPKGTVRGMTWLRV

SEQ ID NO: 1509 - protein, 127 aa, synthetic construct
  REGION 1..127: note = CD112 v60 IgV
QDVRVQVLPEVRGQVGGTVELPCHLLPPVPGLHISLVTWQRPDAPANHQNVAAFHPKMGPSFPSPKPGSERLSFVSAKQSTGQDTEAELQDATLALHGLTVEDEGYYTCEFVTFPKGFVRGMTWLRV

SEQ ID NO: 1510 - protein, 127 aa, synthetic construct
  REGION 1..127: note = CD112 v61 IgV
QDVRVQVLPEVRGQLGGTVELPCHLLPPVPGLYISLMTWQRPDAPANHQNVAAFHPKMGPSFPSPKPGSERLSFVSAKQSTGQDTEAELQDATLALHGLTVEDEGNYTCEFATFPKGFVRGMTWLRV

SEQ ID NO: 1511 - protein, 127 aa, synthetic construct
  REGION 1..127: note = CD112 v62 IgV
QDVRVQVLPEVRGQLGGTVELPCHLLPPVPGLYISLVTWQRPDAPAKHQNVAAFHPKMGPSFPSPKPGSERLSFVSAKQSTGQDTEAELQDATLALHGLTVEDEGNYTCEFVTFPKGYVRGMTWLRV

SEQ ID NO: 1512 - protein, 127 aa, synthetic construct
  REGION 1..127: note = CD112 v63 IgV
QDVRVQVLPEVRGQLGGTVELPCHLLPPVPGLYISLVTWQRPDAPTNHQNVAAFHPKMGPSFPSPKPGSERLSFVSAKQSTGQDTEAELQDATLALHGLTVEDEGNYTCEFVTFPKGSVRGMTWLRV

SEQ ID NO: 1513 - protein, 127 aa, synthetic construct
  REGION 1..127: note = CD112 v64 IgV
QDVRVQVLPEVRGQLGGTVELPCHLLPSVPGLHISLVTWQRPDAPANHQNVAAFHPKMGPSFPSPKPGSERLSFVSAKQSTGQDTEAELQDATLALHGLTVEDEGIYTCEFATFPKGYVRGMTWLRV

SEQ ID NO: 1514 - protein, 127 aa, synthetic construct
  REGION 1..127: note = CD112 v65 IgV
QDVRVQVLPEVRGQLGGTVELPCHLLPPVSGLHISLVTWQRPDAPAKHQNVAAFHPKMGPSFPSPKPGSERLSFMSAKRSTGQDTEAELQDATLALHGLTVEDEGIYTCEFATFPKGYVRGMTWLRV

SEQ ID NO: 1515 - protein, 127 aa, synthetic construct
  REGION 1..127: note = CD112 v66 IgV
QDVRVQVLPEVRGQLGGTAELPCHLLPPVPGLYISLVTWQRPDAPAKHQNVAAFHPKMGPSFPSPKPGSERLSFVSAKQSTGQDTEAELQDATLALHGLTVEDEGYYTCEFATFPEGYVRGMTWLRV

SEQ ID NO: 1516 - protein, 127 aa, synthetic construct
  REGION 1..127: note = CD112 v67 IgV
QDVRVQVLPEVRGQLGGTVELPCHLLPPVPGLYISLVTWQRPDAPANHQNVAAFHPKMGPSFPSPKPGSERLSFVSAKRSTGQDAEAELQDATLALHGLTVEDEGNYTCEFVTFPKGYVRGMTWLRV

SEQ ID NO: 1517 - protein, 127 aa, synthetic construct
  REGION 1..127: note = CD112 v68 IgV
QDVRVQVLPEVRGQLGGTVELPCHLLPPVPGLYISLVTWQRPDAPANHQNVAAFHPKMGPSFPSPKPGSERLSFVSAKQSTGQDTEAELQDATLALHGLTMEDEGIYTCEFATFPKGYVRGMTWLRV

SEQ ID NO: 1518 - protein, 127 aa, synthetic construct
  REGION 1..127: note = CD112 v69 IgV
QDVRVQVLPEVRGQLGGTVELPCHLLPPVPGLHISLVTWQRPDAPANHQNVAAFHPKMGPSFPSPKPGSERLSFVSAKRSTGQDTEAELQDATLALHGLTVEDEGIYTCEFVTFPKGTVRGMTWLRV

SEQ ID NO: 1519 - protein, 127 aa, synthetic construct
  REGION 1..127: note = CD112 v70 IgV
QDVRVQVLPEVRGQLGGTVELPCHLLPPVPGLYISLVTWQRPDAPANHQNVAAFHPKMGPSFPSPKPGSERLSFVSAKRSTGQDTEAELQDATLALHGLTVEDEGNYTCEFVTFPKGSVRGMTWLRV

SEQ ID NO: 1520 - protein, 127 aa, synthetic construct
  REGION 1..127: note = CD112 v71 IgV
QDVRVQVLPEVRGQLGGTVELPCHLLPPVPGLHISLVTWQRPDAPTNHQNVAAFHPKMGPSFPSPKPGSERLSFVSAKRSTGQDTEAELQDATLALHGLTVEDEGIYTCEFATFPKGFVRGMTWLRV

SEQ ID NO: 1521 - protein, 127 aa, synthetic construct
  REGION 1..127: note = CD112 v72 IgV
QDVRVQVLPEVRGQLGGTVELPCHLLPPVPGLYISLVTWQRPDAPANHQNVAAFHPKMGPSFPSPKPGSERLSFVSAKQSTGQDTEAELQDATLALHGLTVEDEGNYTCEFVTFPKGSVRSMTWLRV

SEQ ID NO: 1522 - protein, 127 aa, synthetic construct
  REGION 1..127: note = CD112 v73 IgV
QDVRVQVLPEVRGQLGGTVELPCHLLPPVPGLHISLVTWQRPDAPANHQNVAAFHPKMGPSFPSPKPGSERLSFVSAKRSTGQDTEAELQDATLALHGLTVEDEGIYTCEFATFPKGYVRGMTWLRV

SEQ ID NO: 1523 - protein, 127 aa, synthetic construct
  REGION 1..127: note = CD112 v74 IgV
QDVRVQVLPEVRGQLGGTVELPCHLLPPVPGLHISLVTWQRPDAPANHQNVAAFHPKMGPSFPSPKPGSERLSFVSAKQSTGQDTEAELQDATLALHGLTVEDEGIYTCEFVTFPKGSVRGMTWLRV

SEQ ID NO: 1524 - protein, 127 aa, synthetic construct
  REGION 1..127: note = CD112 v75 IgV
QDVRVQVLPEVRGQLGGTVELPCHLLPPVPGLHISLVTWQRPDAPTNHQNVAAFHPKMGPSFPSPKPGSERLSFVSAKQSTGQDTEAELQDATLALHGLTMEDEGNYTCEFVTFPKGTVRGMTWLRV

SEQ ID NO: 1525 - protein, 127 aa, synthetic construct
  REGION 1..127: note = CD112 v76 IgV
QDVRVQVLPEVRGQLGGTVELPCHLLPPVPGPYISLVTWQRPDAPANHQNVAAFHPKMGPSFPSPKPGSERLSFVSAKQSTGQDTEAELQDATLALHGMTVEDEGIYTCEFATFPKGFVRGMTWLRV

SEQ ID NO: 1526 - protein, 127 aa, synthetic construct
  REGION 1..127: note = CD112 v77 IgV
QDVRVQVLPEVRGQLGGTVELPCHLLPPVPGPYISLVTWQRPDAPANHQNVAAFHPKMGPSFPSPKPGSERLSFVSAKQSTGQDTEAELQDATLALHGLTVEDEGNYACEFATFPKGFVRGMTWLRV

SEQ ID NO: 1527 - protein, 127 aa, synthetic construct
  REGION 1..127: note = CD112 v78 IgV
QDVRVQVLPEVWGQLGGTVELPCHLLPPVPGLYISLVTWQRPDAPANHQNVAAFHPKMGPSFPSPKPGSERLSFVSAKRSTGQDTEAELQDATLALHGLTVEDEGNYTCEFVTFPKGSVRGMTWLRV

SEQ ID NO: 1528 - protein, 127 aa, synthetic construct
  REGION 1..127: note = CD112 v79 IgV
QDVRVQVLPEVRGQLGGTVELPCHLLPPVPGLHISLVTWQRPDAPANHQNVAAFHPKMGPSFPSPKPGSERLSFVSAKQSTGQDTEAELQDATLALHGLTVEDEGYYTCGFVTFPKGSVRGMTWLRV

SEQ ID NO: 1529 - protein, 127 aa, synthetic construct
  REGION 1..127: note = CD112 v80 IgV
QDVRVQVLPEVRGQLGGTVELPCHLLPPVPGLHISLVTWQRPDAPANHQNVAAFHPKMGPSFPSPKPGSERLSFVSAKQSTGQDTEAELQDATLALHGLTVEDEGIYTCEFATFPKGYVRGMTWLRV

SEQ ID NO: 1530 - protein, 127 aa, synthetic construct
  REGION 1..127: note = CD112 v81 IgV
QDVRVQVLPEVRGQLGGTVELPCHLLPPVPGLYISLVTWQRPDAPANHQNVAAFHPKMGPSFPSPKPGSERLSFVSAKRSTGQDTEAELQDATLALHGLTVEDEGNYTCEFATFPKGFVRGMTWLRV

SEQ ID NO: 1531 - protein, 127 aa, synthetic construct
  REGION 1..127: note = CD112 v82 IgV
QDVRVQVLPEVRGQLGGTVELPCHLLPPVPGLHISLVTWQRPDAPANHQNVAAFHPKMGPSFPSPKPGSERLSFVSAKRSTGQDTEAELQDATLALHDLTMEDEGNYTCEFVTFPKGSVRGMTWLRV

SEQ ID NO: 1532 - protein, 127 aa, synthetic construct
  REGION 1..127: note = CD112 v83 IgV
QDVRVQVLPEVRGQLGGTVELPCHLLPPVPGLYISLVTWQRPDAPAKHQNVAAFHPKMGPSFPSPKPGSERLSFVSAKQSSGQDTEAELQDATLALHGLTMEDEGNYTCEFVTFPKGFVRGMTWLRV

SEQ ID NO: 1533 - protein, 127 aa, synthetic construct
  REGION 1..127: note = CD112 v84 IgV
QDVRVQVLPEVRGQLGGTVELPCHLLPPVPGLYISLVTWQRPDAPANHQNVAAFHPKMGPSFPSPKPGSERLSFVSAKQSTSQDTEAELQDATLALHGLTVEDEGNYTCEFATFPKGYVRGMTWLRV

SEQ ID NO: 1534 - protein, 127 aa, synthetic construct
  REGION 1..127: note = CD112 v85 IgV
QDVRVQVLPEVRGQLGGTVELPCHLLPPVPGLHISLVTWQRPDAPANHQNVAAFHPKMGPSFPSPKPGSERLSFVSAKQSTGQDTEAELQDATLALHGLTVEDEGNYTCEFVTFPKGYVRGMTWLRV

SEQ ID NO: 1535 - protein, 127 aa, synthetic construct
  REGION 1..127: note = CD112 v86 IgV
QDVRVQVLPEVRGQLGGTVELPCHLLPPVPGLHISLVTWQRPDAPAKHQNVAAFHPKMGPSFPSPKPGSERLSFVSAKRSTGQDTEAELQDATLALHGLTVEDEGYYTCEFVTFPKGSVRGMTWLRV

SEQ ID NO: 1536 - protein, 127 aa, synthetic construct
  REGION 1..127: note = CD112 v87 IgV
QDVRVQVLPEVRGQLGGTVELPCHLLPPVPGLHISLVTWQRPDAPANHQNVAAFHPKMGPSFPSPKPGSERLSFVSAKQSTGQDTEAELQDATLALHGLTVEDEGNYTCEFATFPKGTVRGMTWLRV

SEQ ID NO: 1537 - protein, 127 aa, synthetic construct
  REGION 1..127: note = CD112 v88 IgV
QDVRVQVLPEVWGQLGGTVELPCHLLPPVPGLHISLVTWQRPDAPANHQNVAAFHPKMGPSFPSPKPGSERLSFVSAKRSTGQDTEAELQDATLALHGLTMEDEGNYTCEFVTFPKGSVRGMTWLRV

SEQ ID NO: 1538 - protein, 329 aa, synthetic construct
  REGION 1..329: note = CD112 v89 ECD
QDVRVQVLPEVRGQLGGTVELPCHLLPPVPGLHISLVTWQRPDAPANHQNVAAFHPKMGPSFPSPKPGSERLSFVSAKQSTGKDTEAELQDATLALHGLTVEDEGNYTCEFVTFPKGTVRGMTWLRVIAKPKNQAEAQKVTFSQDPTTVALCISKEGRPPARISWLSSLDWEAKETQVSGTLAGTVTVTSRFTLVPSGRADGVTVTCKVEHESFEEPALIPVTLSVRYPPEVSISGYDDNWYLGRTDATLSCDVRSNPEPTGYDWSTTSGTFPTSAVAQGSQLVIHAVDSLFNTTFVCTVTNAVGMGRAEQVIFVRETPNTAGAGATGG

SEQ ID NO: 1539 - protein, 329 aa, synthetic construct
  REGION 1..329: note = CD112 v90 ECD
QDVRVQVLPEVRGQLGGTVELPCHLLPPMPGLHISLVTWQRPDAPANHQNVAAFHPKMGPSFPSPKPGSERLSFVSAKQSTGQDTEAELQDATLALHGLTVEDEGIYTCEFATFPKGFVRGMTWLRVIAKPKNQAEAQKVTFSQDPTTVALCISKEGRPPARISWLSSLDWEAKETQVSGTLAGTVTVTSRFTLVPSGRADGVTVTCKVEHESFEEPALIPVTLSVRYPPEVSISGYDDNWYLGRTDATLSCDVRSNPEPTGYDWSTTSGTFPTSAVAQGSQLVIHAVDSLFNTTFVCTVTNAVGMGRAEQVIFVRETPNTAGAGATGG

SEQ ID NO: 1540 - protein, 329 aa, synthetic construct
  REGION 1..329: note = CD112 v91 ECD
QDVRVQVLPEVRGQLGGTVELPCHLLPPVPGLHISLVTWQRPDAPTNHQNVAAFHPKMGPSFPSPKPGSERLSFVSAKQSTGQDTEAELQDATLALHGLTVEDEGNYTCEFVTFPKGSVRGMTWLRVIAKPKNQAEAQKVTFSQDPTTVALCISKEGRPPARISWLSSLDWEAKETQVSGTLAGTVTVTSRFTLVPSGRADGVTVTCKVEHESFEEPALIPVTLSVRYPPEVSISGYDDNWYLGRTDATLSCDVRSNPEPTGYDWSTTSGTFPTSAVAQGSQLVIHAVDSLFNTTFVCTVTNAVGMGRAEQVIFVRETPNTAGAGATGG

SEQ ID NO: 1541 - protein, 329 aa, synthetic construct
  REGION 1..329: note = CD112 v92 ECD
QDVRVQVLPEVRGQLGGTVELPCHLLPPVPGLHISLVTWQRPDAPANHQNVAAFHPKMGPSFPSPKPGSERLSFVSAKRSTGQDTEAELQDATLALHGLTVEDEGNYTCEFATFPKGFVRGMTWLRVIAKPKNQAEAQKVTFSQDPTTVALCISKEGRPPARISWLSSLDWEAKETQVSGTLAGTVTVTSRFTLVPSGRADGVTVTCKVEHESFEEPALIPVTLSVRYPPEVSISGYDDNWYLGRTDATLSCDVRSNPEPTGYDWSTTSGTFPTSAVAQGSQLVIHAVDSLFNTTFVCTVTNAVGMGRAEQVIFVRETPNTAGAGATGG

SEQ ID NO: 1542 - protein, 329 aa, synthetic construct
  REGION 1..329: note = CD112 v93 ECD
QDVRVQVLPEVRGQLGGTVELPCHLLPPVPGLHISLVTWQRPDAPAKHQNVAAFHPKMGPSFPSPKPGSERLSLVSAKQSTGQDTEAELQDATLALHGLTVEDEGNYTCEFATFPKGFVRGMTWLRVIAKPKNQAEAQKVTFSQDPTTVALCISKEGRPPARISWLSSLDWEAKETQVSGTLAGTVTVTSRFTLVPSGRADGVTVTCKVEHESFEEPALIPVTLSVRYPPEVSISGYDDNWYLGRTDATLSCDVRSNPEPTGYDWSTTSGTFPTSAVAQGSQLVIHAVDSLFNTTFVCTVTNAVGMGRAEQVIFVRETPNTAGAGATGG

SEQ ID NO: 1543 - protein, 329 aa, synthetic construct
  REGION 1..329: note = CD112 v94 ECD
QDVRVQVLPEVWGQLGGTVELPCHLLPPVPGLYISLVTWQRPDAPANHQNVAAFHPKMGPSFPSPKPGSERLSFVSAKQSTGQDTEAELQDATLALHGLTMEDEGIYTCEFATFPKGYVRGMTWLRVIAKPKNQAEAQKVTFSQDPTTVALCISKEGRPPARISWLSSLDWEAKETQVSGTLAGTVTVTSRFTLVPSGRADGVTVTCKVEHESFEEPALIPVTLSVRYPPEVSISGYDDNWYLGRTDATLSCDVRSNPEPTGYDWSTTSGTFPTSAVAQGSQLVIHAVDSLFNTTFVCTVTNAVGMGRAEQVIFVRETPNTAGAGATGG

SEQ ID NO: 1544 - protein, 329 aa, synthetic construct
  REGION 1..329: note = CD112 v95 ECD
QDVRVQVLPEVRGQLGGTVELPCHLLPPVPGLYISLVTWQRPDAPTNHQNVAAFHPKMGPSFPSPKPGSERLSFVSAKQSTGQDTEAELQDATLALHGLTAEDEGIYTCEFATFPKGYVRGMTWLRVIAKPKNQAEAQKVTFSQDPTTVALCISKEGRPPARISWLSSLDWEAKETQVSGTLAGTVTVTSRFTLVPSGRADGVTVTCKVEHESFEEPALIPVTLSVRYPPEVSISGYDDNWYLGRTDATLSCDVRSNPEPTGYDWSTTSGTFPTSAVAQGSQLVIHAVDSLFNTTFVCTVTNAVGMGRAEQVIFVRETPNTAGAGATGG

SEQ ID NO: 1545 - protein, 329 aa, synthetic construct
  REGION 1..329: note = CD112 v96 ECD
QDVRVQVLPEVRGQLGGTVELPCHLLPPVPGLYISLVTWQRPDAPANHQNVAAFHPKMGPSFPSPKPGSERLSFVSAKQSTGQDTEAELQDATLALHGLTVEDEGYYTCEFVTFPKGTVRGMTWLRVIAKPKNQAEAQKVTFSQDPTTVALCISKEGRPPARISWLSSLDWEAKETQVSGTLAGTVTVTSRFTLVPSGRADGVTVTCKVEHESFEEPALIPVTLSVRYPPEVSISGYDDNWYLGRTDATLSCDVRSNPEPTGYDWSTTSGTFPTSAVAQGSQLVIHAVDSLFNTTFVCTVTNAVGMGRAEQVIFVRETPNTAGAGATGG

SEQ ID NO: 1546 - protein, 329 aa, synthetic construct
  REGION 1..329: note = CD112 v97 ECD
QDVRVQVLPEVRGQLGGTVELPCHLLPPVPGLYISLVTWQRPDAPANHQNVAAFHPKMGPSFPSPKPGSERLSFVPAKQSIGQDTEAELQDATLALHGLTMEDEGYYTCEFVTFPKGFVRGMTWLRVIAKPKNQAEAQKVTFSQDPTTVALCISKEGRPPARISWLSSLDWEAKETQVSGTLAGTVTVTSRFTLVPSGRADGVTVTCKVEHESFEEPALIPVTLSVRYPPEVSISGYDDNWYLGRTDATLSCDVRSNPEPTGYDWSTTSGTFPTSAVAQGSQLVIHAVDSLFNTTFVCTVTNAVGMGRAEQVIFVRETPNTAGAGATGG

SEQ ID NO: 1547 - protein, 329 aa, synthetic construct
  REGION 1..329: note = CD112 v98 ECD
QDVRVQVLREVRGQLGGTVEVLCHLLPPVPGLYMSLVTWQRPDAPANHQNVAAFHPKMGPSFPSPKPGFERLSLVSAKQSTGQDTEVELQDATLALHGLTVEDEGNYTCEFVTFPKGSVRGMTWARVIAKPKNQAEAQKVTFSQDPTTVALCISKEGRPPARISWLSSLDWEAKETQVSGTLAGTVTVTSRFTLVPSGRADGVTVTCKVEHESFEEPALIPVTLSVRYPPEVSISGYDDNWYLGRTDATLSCDVRSNPEPTGYDWSTTSGTFPTSAVAQGSQLVIHAVDSLFNTTFVCTVTNAVGMGRAEQVIFVRETPNTAGAGATGG

SEQ ID NO: 1548 - protein, 329 aa, synthetic construct
  REGION 1..329: note = CD112 v99 ECD
QDVRVQVLPEVRGQLGGTVELPCHLLPPVPGLHISLVTWQRPDAPANHQNVAAFHPKMGPSFPSPKPGSERLSFVSAKQSTGQDTEAELQDATLALHGLTMEDEGNYTCEFVTFPKGSVRGMTWLRVIAKPKNQAEAQKVTFSQDPTTVALCISKEGRPPARISWLSSLDWEAKETQVSGTLAGTVTVTSRFTLVPSGRADGVTVTCKVEHESFEEPALIPVTLSVRYPPEVSISGYDDNWYLGRTDATLSCDVRSNPEPTGYDWSTTSGTFPTSAVAQGSQLVIHAVDSLFNTTFVCTVTNAVGMGRAEQVIFVRETPNTAGAGATGG

SEQ ID NO: 1549 - protein, 329 aa, synthetic construct
  REGION 1..329: note = CD112 v100 ECD
QDVRVQVLPEVRGQLGGTVELPCHLLPPAPGPYISLVTWQRPDAPANHQNVAAFHPKMGPSFPSPKPGSERLSFVSAKQSTGQDTEAELQDATLALHGLTVEDEGNYTCEFATFPKGFVRGMTWLRVIAKPKNQAEAQKVTFSQDPTTVALCISKEGRPPARISWLSSLDWEAKETQVSGTLAGTVTVTSRFTLVPSGRADGVTVTCKVEHESFEEPALIPVTLSVRYPPEVSISGYDDNWYLGRTDATLSCDVRSNPEPTGYDWSTTSGTFPTSAVAQGSQLVIHAVDSLFNTTFVCTVTNAVGMGRAEQVIFVRETPNTAGAGATGG

SEQ ID NO: 1550 - protein, 329 aa, synthetic construct
  REGION 1..329: note = CD112 v101 ECD
QDVRVQVLPEVRGQLGGTVELPCHLLPPVPGLHISLVTWQRPDAPANHQNVAAFHPKMGPSFPSPKPGSERLSFVSAKQSTGQDTEAELQDATLALHGLTMEDEGIYTCEFVTFPKGSVRGMTWLRVIAKPKNQAEAQKVTFSQDPTTVALCISKEGRPPARISWLSSLDWEAKETQVSGTLAGTVTVTSRFTLVPSGRADGVTVTCKVEHESFEEPALIPVTLSVRYPPEVSISGYDDNWYLGRTDATLSCDVRSNPEPTGYDWSTTSGTFPTSAVAQGSQLVIHAVDSLFNTTFVCTVTNAVGMGRAEQVIFVRETPNTAGAGATGG

SEQ ID NO: 1551 - protein, 329 aa, synthetic construct
  REGION 1..329: note = CD112 v102 ECD
QDVRVQVLPEVWGQLGGTVELPCHLLPPVPGLHISLVTWQRPDAPAKHQNVAAFHPKMGPSFPSPKPGSERLSFVSAKRSTGQDTEAELQDATLALHGLTVEDEGNYTCEFATFPKGYVRGMTWLRVIAKPKNQAEAQKVTFSQDPTTVALCISKEGRPPARISWLSSLDWEAKETQVSGTLAGTVTVTSRFTLVPSGRADGVTVTCKVEHESFEEPALIPVTLSVRYPPEVSISGYDDNWYLGRTDATLSCDVRSNPEPTGYDWSTTSGTFPTSAVAQGSQLVIHAVDSLFNTTFVCTVTNAVGMGRAEQVIFVRETPNTAGAGATGG

SEQ ID NO: 1552 - protein, 329 aa, synthetic construct
  REGION 1..329: note = CD112 v103 ECD
QDVRVQVLPEVRGQLGGTVELPCHLLPPVPGLHISLVTWQRPDAPTNHQNVAAFHPKMGPSFPSPKPGSERLSFVSAKQSTGQDTEAELQDATLALHGLTVEDEGNYTCEFVTFPKGTVRGMTWLRVIAKPKNQAEAQKVTFSQDPTTVALCISKEGRPPARISWLSSLDWEAKETQVSGTLAGTVTVTSRFTLVPSGRADGVTVTCKVEHESFEEPALIPVTLSVRYPPEVSISGYDDNWYLGRTDATLSCDVRSNPEPTGYDWSTTSGTFPTSAVAQGSQLVIHAVDSLFNTTFVCTVTNAVGMGRAEQVIFVRETPNTAGAGATGG

SEQ ID NO: 1553 - protein, 329 aa, synthetic construct
  REGION 1..329: note = CD112 v104 ECD
QDVRVQVLPEVRGQLGGTVELPCHLLPPVPGLHISLVTWQRPDAPANHQNVAAFHPKMGPSFPSPKPGSERLSFVSAKQSTGQDTEAELQDATLALHGLTVEDEGNYTCEFVTLPKGTVRGMTWLRVIAKPKNQAEAQKVTFSQDPTTVALCISKEGRPPARISWLSSLDWEAKETQVSGTLAGTVTVTSRFTLVPSGRADGVTVTCKVEHESFEEPALIPVTLSVRYPPEVSISGYDDNWYLGRTDATLSCDVRSNPEPTGYDWSTTSGTFPTSAVAQGSQLVIHAVDSLFNTTFVCTVTNAVGMGRAEQVIFVRETPNTAGAGATGG

SEQ ID NO: 1554 - protein, 329 aa, synthetic construct
  REGION 1..329: note = CD112 v105 ECD
QDVRVQVLPEVRGQLGGTVELPCHLLPPVPGLHISLVAWQRPDAPTNHQNVAAFHPKMGPSFPSPKPGSERLSFVSAKQSTGQDTEAELQDATLALHGLTMEDEGNYTCEFVTFPKGSVRGMTWLRVIAKPKNQAEAQKVTFSQDPTTVALCISKEGRPPARISWLSSLDWEAKETQVSGTLAGTVTVTSRFTLVPSGRADGVTVTCKVEHESFEEPALIPVTLSVRYPPEVSISGYDDNWYLGRTDATLSCDVRSNPEPTGYDWSTTSGTFPTSAVAQGSQLVIHAVDSLFNTTFVCTVTNAVGMGRAEQVIFVRETPNTAGAGATGG

SEQ ID NO: 1555 - protein, 329 aa, synthetic construct
  REGION 1..329: note = CD112 v106 ECD
QDVRVQVLPEVRGQLGGTVELPCHLLPSVPGLHISLVTWQRPDAPANHQNVAAFHPKMGPSFPSPKPGPERLSFVSAKQSTGQDTEAELQDATLALHGLTVEDEGIYTCEFVTFPKGYVRGMTWLRVIAKPKNQAEAQKVTFSQDPTTVALCISKEGRPPARISWLSSLDWEAKETQVSGTLAGTVTVTSRFTLVPSGRADGVTVTCKVEHESFEEPALIPVTLSVRYPPEVSISGYDDNWYLGRTDATLSCDVRSNPEPTGYDWSTTSGTFPTSAVAQGSQLVIHAVDSLFNTTFVCTVTNAVGMGRAEQVIFVRETPNTAGAGATGG

SEQ ID NO: 1556 - protein, 329 aa, synthetic construct
  REGION 1..329: note = CD112 v107 ECD
QDVRVQVLPEVRGQLGGTVELPCHLLPPVPGLHISLVTWQRLDAPAKHQNVAAFHPKMGPSFPSPKPGSERLSFVSAKQSTGQDTEAELQDATLALHGLTMEDEGNYTCEFVTFPKGSVRGMTWLRVIAKPKNQAEAQKVTFSQDPTTVALCISKEGRPPARISWLSSLDWEAKETQVSGTLAGTVTVTSRFTLVPSGRADGVTVTCKVEHESFEEPALIPVTLSVRYPPEVSISGYDDNWYLGRTDATLSCDVRSNPEPTGYDWSTTSGTFPTSAVAQGSQLVIHAVDSLFNTTFVCTVTNAVGMGRAEQVIFVRETPNTAGAGATGG

SEQ ID NO: 1557 - protein, 329 aa, synthetic construct
  REGION 1..329: note = CD112 v108 ECD
QDVRVQVLPEVRGQLGGTVELPCHLLPPVPGLHISLVTWQRPDAPAKHQNVAAFHPKMGPSFPSPKPGSERLSSVSAKQSTGKDTEAELQDATLALHGLTVEDEGIYTCELVTFPKGTVRGMTWLRVIAKPKNQAEAQKVTFSQDPTTVALCISKEGRPPARISWLSSLDWEAKETQVSGTLAGTVTVTSRFTLVPSGRADGVTVTCKVEHESFEEPALIPVTLSVRYPPEVSISGYDDNWYLGRTDATLSCDVRSNPEPTGYDWSTTSGTFPTSAVAQGSQLVIHAVDSLFNTTFVCTVTNAVGMGRAEQVIFVRETPNTAGAGATGG

SEQ ID NO: 1558 - protein, 329 aa, synthetic construct
  REGION 1..329: note = CD112 v109 ECD
QDVRVQVLPEVRGQLGGTVELPCHLLPPVPGLHISLVTWQRPDAPANHQNVAAFHPKMGPSFPSPKPGSERLSFVSAKQSTGQDTEAELQDATLALHGLTVEDEGNYTCEFVTFPKGTARGMTWLRVIAKPKNQAEAQKVTFSQDPTTVALCISKEGRPPARISWLSSLDWEAKETQVSGTLAGTVTVTSRFTLVPSGRADGVTVTCKVEHESFEEPALIPVTLSVRYPPEVSISGYDDNWYLGRTDATLSCDVRSNPEPTGYDWSTTSGTFPTSAVAQGSQLVIHAVDSLFNTTFVCTVTNAVGMGRAEQVIFVRETPNTAGAGATGG

SEQ ID NO: 1559 - protein, 329 aa, synthetic construct
  REGION 1..329: note = CD112 v100 ECD
QDVRVQVLPEVRGQLGGTVELPCHLLPPVPGLHISLVTWQRPDAPANHQNVAAFHPKMGPSFPSPKPGSERLSFVSAKQSTGQDTEAELQDATLALHGLTVEDEGIYTCEFVTFPKGFVRGMTWLRVIAKPKNQAEAQKVTFSQDPTTVALCISKEGRPPARISWLSSLDWEAKETQVSGTLAGTVTVTSRFTLVPSGRADGVTVTCKVEHESFEEPALIPVTLSVRYPPEVSISGYDDNWYLGRTDATLSCDVRSNPEPTGYDWSTTSGTFPTSAVAQGSQLVIHAVDSLFNTTFVCTVTNAVGMGRAEQVIFVRETPNTAGAGATGG

SEQ ID NO: 1560 - protein, 329 aa, synthetic construct
  REGION 1..329: note = CD112 v111 ECD
QDVRVQVLPEVRGQLGGTVELPCHLLPPVPGLHISLVTWQRPDAPANHQNVAAFHPKMGPSFPSPMPGSERLSFVSAKQSTGQDTEAELQDATLALHGLTVEDEGNYTCEFATFPKGFVRGMTLLRVIAKPKNQAEAQKVTFSQDPTTVALCISKEGRPPARISWLSSLDWEAKETQVSGTLAGTVTVTSRFTLVPSGRADGVTVTCKVEHESFEEPALIPVTLSVRYPPEVSISGYDDNWYLGRTDATLSCDVRSNPEPTGYDWSTTSGTFPTSAVAQGSQLVIHAVDSLFNTTFVCTVTNAVGMGRAEQVIFVRETPNTAGAGATGG

SEQ ID NO: 1561 - protein, 329 aa, synthetic construct
  REGION 1..329: note = CD112 v112 ECD
QDVRVQVLPEVRGQLGGTVELPCHLLPPVPGLYISLVTWQRPDAPANHQNVAAFHPKMGPSFPSPKPGSERLSFVSAKQSTGQDTEAELQDATLALHGLTVEDEGIYTCEFVTFPKGSVRGMTWLRVIAKPKNQAEAQKVTFSQDPTTVALCISKEGRPPARISWLSSLDWEAKETQVSGTLAGTVTVTSRFTLVPSGRADGVTVTCKVEHESFEEPALIPVTLSVRYPPEVSISGYDDNWYLGRTDATLSCDVRSNPEPTGYDWSTTSGTFPTSAVAQGSQLVIHAVDSLFNTTFVCTVTNAVGMGRAEQVIFVRETPNTAGAGATGG

SEQ ID NO: 1562 - protein, 125 aa, synthetic construct
  REGION 1..125: note = CD112 v89 IgV
QDVRVQVLPEVRGQLGGTVELPCHLLPPVPGLHISLVTWQRPDAPANHQNVAAFHPKMGPSFPSPKPGSERLSFVSAKQSTGKDTEAELQDATLALHGLTVEDEGNYTCEFVTFPKGTVRGMTWL

SEQ ID NO: 1563 - protein, 125 aa, synthetic construct
  REGION 1..125: note = CD112 v90 IgV
QDVRVQVLPEVRGQLGGTVELPCHLLPPMPGLHISLVTWQRPDAPANHQNVAAFHPKMGPSFPSPKPGSERLSFVSAKQSTGQDTEAELQDATLALHGLTVEDEGIYTCEFATFPKGFVRGMTWL

SEQ ID NO: 1564 - protein, 125 aa, synthetic construct
  REGION 1..125: note = CD112 v91 IgV
QDVRVQVLPEVRGQLGGTVELPCHLLPPVPGLHISLVTWQRPDAPTNHQNVAAFHPKMGPSFPSPKPGSERLSFVSAKQSTGQDTEAELQDATLALHGLTVEDEGNYTCEFVTFPKGSVRGMTWL

SEQ ID NO: 1565 - protein, 125 aa, synthetic construct
  REGION 1..125: note = CD112 v92 IgV
QDVRVQVLPEVRGQLGGTVELPCHLLPPVPGLHISLVTWQRPDAPANHQNVAAFHPKMGPSFPSPKPGSERLSFVSAKRSTGQDTEAELQDATLALHGLTVEDEGNYTCEFATFPKGFVRGMTWL

SEQ ID NO: 1566 - protein, 125 aa, synthetic construct
  REGION 1..125: note = CD112 v93 IgV
QDVRVQVLPEVRGQLGGTVELPCHLLPPVPGLHISLVTWQRPDAPAKHQNVAAFHPKMGPSFPSPKPGSERLSLVSAKQSTGQDTEAELQDATLALHGLTVEDEGNYTCEFATFPKGFVRGMTWL

SEQ ID NO: 1567 - protein, 125 aa, synthetic construct
  REGION 1..125: note = CD112 v94 IgV
QDVRVQVLPEVWGQLGGTVELPCHLLPPVPGLYISLVTWQRPDAPANHQNVAAFHPKMGPSFPSPKPGSERLSFVSAKQSTGQDTEAELQDATLALHGLTMEDEGIYTCEFATFPKGYVRGMTWL

SEQ ID NO: 1568 - protein, 125 aa, synthetic construct
  REGION 1..125: note = CD112 v95 IgV
QDVRVQVLPEVRGQLGGTVELPCHLLPPVPGLYISLVTWQRPDAPTNHQNVAAFHPKMGPSFPSPKPGSERLSFVSAKQSTGQDTEAELQDATLALHGLTAEDEGIYTCEFATFPKGYVRGMTWL

SEQ ID NO: 1569 - protein, 125 aa, synthetic construct
  REGION 1..125: note = CD112 v96 IgV
QDVRVQVLPEVRGQLGGTVELPCHLLPPVPGLYISLVTWQRPDAPANHQNVAAFHPKMGPSFPSPKPGSERLSFVSAKQSTGQDTEAELQDATLALHGLTVEDEGYYTCEFVTFPKGTVRGMTWL

SEQ ID NO: 1570 - protein, 125 aa, synthetic construct
  REGION 1..125: note = CD112 v97 IgV
QDVRVQVLPEVRGQLGGTVELPCHLLPPVPGLYISLVTWQRPDAPANHQNVAAFHPKMGPSFPSPKPGSERLSFVPAKQSIGQDTEAELQDATLALHGLTMEDEGYYTCEFVTFPKGFVRGMTWL

SEQ ID NO: 1571 - protein, 125 aa, synthetic construct
  REGION 1..125: note = CD112 v98 IgV
QDVRVQVLREVRGQLGGTVEVLCHLLPPVPGLYMSLVTWQRPDAPANHQNVAAFHPKMGPSFPSPKPGFERLSLVSAKQSTGQDTEVELQDATLALHGLTVEDEGNYTCEFVTFPKGSVRGMTWA

SEQ ID NO: 1572 - protein, 125 aa, synthetic construct
  REGION 1..125: note = CD112 v99 IgV
QDVRVQVLPEVRGQLGGTVELPCHLLPPVPGLHISLVTWQRPDAPANHQNVAAFHPKMGPSFPSPKPGSERLSFVSAKQSTGQDTEAELQDATLALHGLTMEDEGNYTCEFVTFPKGSVRGMTWL

SEQ ID NO: 1573 - protein, 125 aa, synthetic construct
  REGION 1..125: note = CD112 v100 IgV
QDVRVQVLPEVRGQLGGTVELPCHLLPPAPGPYISLVTWQRPDAPANHQNVAAFHPKMGPSFPSPKPGSERLSFVSAKQSTGQDTEAELQDATLALHGLTVEDEGNYTCEFATFPKGFVRGMTWL

SEQ ID NO: 1574 - protein, 125 aa, synthetic construct
  REGION 1..125: note = CD112 v101 IgV
QDVRVQVLPEVRGQLGGTVELPCHLLPPVPGLHISLVTWQRPDAPANHQNVAAFHPKMGPSFPSPKPGSERLSFVSAKQSTGQDTEAELQDATLALHGLTMEDEGIYTCEFVTFPKGSVRGMTWL

SEQ ID NO: 1575 - protein, 125 aa, synthetic construct
  REGION 1..125: note = CD112 v102 IgV
QDVRVQVLPEVWGQLGGTVELPCHLLPPVPGLHISLVTWQRPDAPAKHQNVAAFHPKMGPSFPSPKPGSERLSFVSAKRSTGQDTEAELQDATLALHGLTVEDEGNYTCEFATFPKGYVRGMTWL

SEQ ID NO: 1576 - protein, 125 aa, synthetic construct
  REGION 1..125: note = CD112 v103 IgV
QDVRVQVLPEVRGQLGGTVELPCHLLPPVPGLHISLVTWQRPDAPTNHQNVAAFHPKMGPSFPSPKPGSERLSFVSAKQSTGQDTEAELQDATLALHGLTVEDEGNYTCEFVTFPKGTVRGMTWL

SEQ ID NO: 1577 - protein, 125 aa, synthetic construct
  REGION 1..125: note = CD112 v104 IgV
QDVRVQVLPEVRGQLGGTVELPCHLLPPVPGLHISLVTWQRPDAPANHQNVAAFHPKMGPSFPSPKPGSERLSFVSAKQSTGQDTEAELQDATLALHGLTVEDEGNYTCEFVTLPKGTVRGMTWL

SEQ ID NO: 1578 - protein, 125 aa, synthetic construct
  REGION 1..125: note = CD112 v105 IgV
QDVRVQVLPEVRGQLGGTVELPCHLLPPVPGLHISLVAWQRPDAPTNHQNVAAFHPKMGPSFPSPKPGSERLSFVSAKQSTGQDTEAELQDATLALHGLTMEDEGNYTCEFVTFPKGSVRGMTWL

SEQ ID NO: 1579 - protein, 125 aa, synthetic construct
  REGION 1..125: note = CD112 v106 IgV
QDVRVQVLPEVRGQLGGTVELPCHLLPSVPGLHISLVTWQRPDAPANHQNVAAFHPKMGPSFPSPKPGPERLSFVSAKQSTGQDTEAELQDATLALHGLTVEDEGIYTCEFVTFPKGYVRGMTWL

SEQ ID NO: 1580 - protein, 125 aa, synthetic construct
  REGION 1..125: note = CD112 v107 IgV
QDVRVQVLPEVRGQLGGTVELPCHLLPPVPGLHISLVTWQRLDAPAKHQNVAAFHPKMGPSFPSPKPGSERLSFVSAKQSTGQDTEAELQDATLALHGLTMEDEGNYTCEFVTFPKGSVRGMTWL

SEQ ID NO: 1581 - protein, 125 aa, synthetic construct
  REGION 1..125: note = CD112 v108 IgV
QDVRVQVLPEVRGQLGGTVELPCHLLPPVPGLHISLVTWQRPDAPAKHQNVAAFHPKMGPSFPSPKPGSERLSSVSAKQSTGKDTEAELQDATLALHGLTVEDEGIYTCELVTFPKGTVRGMTWL

SEQ ID NO: 1582 - protein, 125 aa, synthetic construct
  REGION 1..125: note = CD112 v109 IgV
QDVRVQVLPEVRGQLGGTVELPCHLLPPVPGLHISLVTWQRPDAPANHQNVAAFHPKMGPSFPSPKPGSERLSFVSAKQSTGQDTEAELQDATLALHGLTVEDEGNYTCEFVTFPKGTARGMTWL

SEQ ID NO: 1583 - protein, 125 aa, synthetic construct
  REGION 1..125: note = CD112 v100 IgV
QDVRVQVLPEVRGQLGGTVELPCHLLPPVPGLHISLVTWQRPDAPANHQNVAAFHPKMGPSFPSPKPGSERLSFVSAKQSTGQDTEAELQDATLALHGLTVEDEGIYTCEFVTFPKGFVRGMTWL

SEQ ID NO: 1584 - protein, 125 aa, synthetic construct
  REGION 1..125: note = CD112 v111 IgV
QDVRVQVLPEVRGQLGGTVELPCHLLPPVPGLHISLVTWQRPDAPANHQNVAAFHPKMGPSFPSPMPGSERLSFVSAKQSTGQDTEAELQDATLALHGLTVEDEGNYTCEFATFPKGFVRGMTLL

SEQ ID NO: 1585 - protein, 125 aa, synthetic construct
  REGION 1..125: note = CD112 v112 IgV
QDVRVQVLPEVRGQLGGTVELPCHLLPPVPGLYISLVTWQRPDAPANHQNVAAFHPKMGPSFPSPKPGSERLSFVSAKQSTGQDTEAELQDATLALHGLTVEDEGIYTCEFVTFPKGSVRGMTWL

SEQ ID NO: 1586 - protein, 127 aa, synthetic construct
  REGION 1..127: note = CD112 v89 IgV
QDVRVQVLPEVRGQLGGTVELPCHLLPPVPGLHISLVTWQRPDAPANHQNVAAFHPKMGPSFPSPKPGSERLSFVSAKQSTGKDTEAELQDATLALHGLTVEDEGNYTCEFVTFPKGTVRGMTWLRV

SEQ ID NO: 1587 - protein, 127 aa, synthetic construct
  REGION 1..127: note = CD112 v90 IgV
QDVRVQVLPEVRGQLGGTVELPCHLLPPMPGLHISLVTWQRPDAPANHQNVAAFHPKMGPSFPSPKPGSERLSFVSAKQSTGQDTEAELQDATLALHGLTVEDEGIYTCEFATFPKGFVRGMTWLRV

SEQ ID NO: 1588 - protein, 127 aa, synthetic construct
  REGION 1..127: note = CD112 v91 IgV
QDVRVQVLPEVRGQLGGTVELPCHLLPPVPGLHISLVTWQRPDAPTNHQNVAAFHPKMGPSFPSPKPGSERLSFVSAKQSTGQDTEAELQDATLALHGLTVEDEGNYTCEFVTFPKGSVRGMTWLRV

SEQ ID NO: 1589 - protein, 127 aa, synthetic construct
  REGION 1..127: note = CD112 v92 IgV
QDVRVQVLPEVRGQLGGTVELPCHLLPPVPGLHISLVTWQRPDAPANHQNVAAFHPKMGPSFPSPKPGSERLSFVSAKRSTGQDTEAELQDATLALHGLTVEDEGNYTCEFATFPKGFVRGMTWLRV

SEQ ID NO: 1590 - protein, 127 aa, synthetic construct
  REGION 1..127: note = CD112 v93 IgV
QDVRVQVLPEVRGQLGGTVELPCHLLPPVPGLHISLVTWQRPDAPAKHQNVAAFHPKMGPSFPSPKPGSERLSLVSAKQSTGQDTEAELQDATLALHGLTVEDEGNYTCEFATFPKGFVRGMTWLRV

SEQ ID NO: 1591 - protein, 127 aa, synthetic construct
  REGION 1..127: note = CD112 v94 IgV
QDVRVQVLPEVWGQLGGTVELPCHLLPPVPGLYISLVTWQRPDAPANHQNVAAFHPKMGPSFPSPKPGSERLSFVSAKQSTGQDTEAELQDATLALHGLTMEDEGIYTCEFATFPKGYVRGMTWLRV

SEQ ID NO: 1592 - protein, 127 aa, synthetic construct
  REGION 1..127: note = CD112 v95 IgV
QDVRVQVLPEVRGQLGGTVELPCHLLPPVPGLYISLVTWQRPDAPTNHQNVAAFHPKMGPSFPSPKPGSERLSFVSAKQSTGQDTEAELQDATLALHGLTAEDEGIYTCEFATFPKGYVRGMTWLRV

SEQ ID NO: 1593 - protein, 127 aa, synthetic construct
  REGION 1..127: note = CD112 v96 IgV
QDVRVQVLPEVRGQLGGTVELPCHLLPPVPGLYISLVTWQRPDAPANHQNVAAFHPKMGPSFPSPKPGSERLSFVSAKQSTGQDTEAELQDATLALHGLTVEDEGYYTCEFVTFPKGTVRGMTWLRV

SEQ ID NO: 1594 - protein, 127 aa, synthetic construct
  REGION 1..127: note = CD112 v97 IgV
QDVRVQVLPEVRGQLGGTVELPCHLLPPVPGLYISLVTWQRPDAPANHQNVAAFHPKMGPSFPSPKPGSERLSFVPAKQSIGQDTEAELQDATLALHGLTMEDEGYYTCEFVTFPKGFVRGMTWLRV

SEQ ID NO: 1595 - protein, 127 aa, synthetic construct
  REGION 1..127: note = CD112 v98 IgV
QDVRVQVLREVRGQLGGTVEVLCHLLPPVPGLYMSLVTWQRPDAPANHQNVAAFHPKMGPSFPSPKPGFERLSLVSAKQSTGQDTEVELQDATLALHGLTVEDEGNYTCEFVTFPKGSVRGMTWARV

SEQ ID NO: 1596 - protein, 127 aa, synthetic construct
  REGION 1..127: note = CD112 v99 IgV
QDVRVQVLPEVRGQLGGTVELPCHLLPPVPGLHISLVTWQRPDAPANHQNVAAFHPKMGPSFPSPKPGSERLSFVSAKQSTGQDTEAELQDATLALHGLTMEDEGNYTCEFVTFPKGSVRGMTWLRV

SEQ ID NO: 1597 - protein, 127 aa, synthetic construct
  REGION 1..127: note = CD112 v100 IgV
QDVRVQVLPEVRGQLGGTVELPCHLLPPAPGPYISLVTWQRPDAPANHQNVAAFHPKMGPSFPSPKPGSERLSFVSAKQSTGQDTEAELQDATLALHGLTVEDEGNYTCEFATFPKGFVRGMTWLRV

SEQ ID NO: 1598 - protein, 127 aa, synthetic construct
  REGION 1..127: note = CD112 v101 IgV
QDVRVQVLPEVRGQLGGTVELPCHLLPPVPGLHISLVTWQRPDAPANHQNVAAFHPKMGPSFPSPKPGSERLSFVSAKQSTGQDTEAELQDATLALHGLTMEDEGIYTCEFVTFPKGSVRGMTWLRV

SEQ ID NO: 1599 - protein, 127 aa, synthetic construct
  REGION 1..127: note = CD112 v102 IgV
QDVRVQVLPEVWGQLGGTVELPCHLLPPVPGLHISLVTWQRPDAPAKHQNVAAFHPKMGPSFPSPKPGSERLSFVSAKRSTGQDTEAELQDATLALHGLTVEDEGNYTCEFATFPKGYVRGMTWLRV

SEQ ID NO: 1600 - protein, 127 aa, synthetic construct
  REGION 1..127: note = CD112 v103 IgV
QDVRVQVLPEVRGQLGGTVELPCHLLPPVPGLHISLVTWQRPDAPTNHQNVAAFHPKMGPSFPSPKPGSERLSFVSAKQSTGQDTEAELQDATLALHGLTVEDEGNYTCEFVTFPKGTVRGMTWLRV

SEQ ID NO: 1601 - protein, 127 aa, synthetic construct
  REGION 1..127: note = CD112 v104 IgV
QDVRVQVLPEVRGQLGGTVELPCHLLPPVPGLHISLVTWQRPDAPANHQNVAAFHPKMGPSFPSPKPGSERLSFVSAKQSTGQDTEAELQDATLALHGLTVEDEGNYTCEFVTLPKGTVRGMTWLRV

SEQ ID NO: 1602 - protein, 127 aa, synthetic construct
  REGION 1..127: note = CD112 v105 IgV
QDVRVQVLPEVRGQLGGTVELPCHLLPPVPGLHISLVAWQRPDAPTNHQNVAAFHPKMGPSFPSPKPGSERLSFVSAKQSTGQDTEAELQDATLALHGLTMEDEGNYTCEFVTFPKGSVRGMTWLRV

SEQ ID NO: 1603 - protein, 127 aa, synthetic construct
  REGION 1..127: note = CD112 v106 IgV
QDVRVQVLPEVRGQLGGTVELPCHLLPSVPGLHISLVTWQRPDAPANHQNVAAFHPKMGPSFPSPKPGPERLSFVSAKQSTGQDTEAELQDATLALHGLTVEDEGIYTCEFVTFPKGYVRGMTWLRV

SEQ ID NO: 1604 - protein, 127 aa, synthetic construct
  REGION 1..127: note = CD112 v107 IgV
QDVRVQVLPEVRGQLGGTVELPCHLLPPVPGLHISLVTWQRLDAPAKHQNVAAFHPKMGPSFPSPKPGSERLSFVSAKQSTGQDTEAELQDATLALHGLTMEDEGNYTCEFVTFPKGSVRGMTWLRV

SEQ ID NO: 1605 - protein, 127 aa, synthetic construct
  REGION 1..127: note = CD112 v109 IgV
QDVRVQVLPEVRGQLGGTVELPCHLLPPVPGLHISLVTWQRPDAPAKHQNVAAFHPKMGPSFPSPKPGSERLSSVSAKQSTGKDTEAELQDATLALHGLTVEDEGIYTCELVTFPKGTVRGMTWLRV

SEQ ID NO: 1606 - protein, 127 aa, synthetic construct
  REGION 1..127: note = CD112 v109 IgV
QDVRVQVLPEVRGQLGGTVELPCHLLPPVPGLHISLVTWQRPDAPANHQNVAAFHPKMGPSFPSPKPGSERLSFVSAKQSTGQDTEAELQDATLALHGLTVEDEGNYTCEFVTFPKGTARGMTWLRV

SEQ ID NO: 1607 - protein, 127 aa, synthetic construct
  REGION 1..127: note = CD112 v100 IgV
QDVRVQVLPEVRGQLGGTVELPCHLLPPVPGLHISLVTWQRPDAPANHQNVAAFHPKMGPSFPSPKPGSERLSFVSAKQSTGQDTEAELQDATLALHGLTVEDEGIYTCEFVTFPKGFVRGMTWLRV

SEQ ID NO: 1608 - protein, 127 aa, synthetic construct
  REGION 1..127: note = CD112 v111 IgV
QDVRVQVLPEVRGQLGGTVELPCHLLPPVPGLHISLVTWQRPDAPANHQNVAAFHPKMGPSFPSPMPGSERLSFVSAKQSTGQDTEAELQDATLALHGLTVEDEGNYTCEFATFPKGFVRGMTLLRV

SEQ ID NO: 1609 - protein, 127 aa, synthetic construct
  REGION 1..127: note = CD112 v112 IgV
QDVRVQVLPEVRGQLGGTVELPCHLLPPVPGLYISLVTWQRPDAPANHQNVAAFHPKMGPSFPSPKPGSERLSFVSAKQSTGQDTEAELQDATLALHGLTVEDEGIYTCEFVTFPKGSVRGMTWLRV

SEQ ID NO: 1610 - protein, 323 aa, synthetic construct
  REGION 1..323: note = CD155 v144 ECD
WPPPGTGDVVVQAPTQVTDFLGDSVTLPCYLQVPNTEVTHVSQLTWARHGESGNMAVFHQTQGPSYSESKRLEFVAARPGAEQRNASLRMSGLRVEDEGNYTCLFVMYPQGSRSVDIWLRVLAKPQNTAEVQKVQLTGEPVPMARCVSTGGRPPAQITWHSDLGGMPNTSQVPGFLSGTVTVTSLWILVPSSQVDGKNVTCKVEHESFEKPQLLTVNLTVYYPPEVSISGYDNNWYLGQNEATLTCDARSNPEPTGYNWSTTMGPLPPFAVAQGAQLLIRPVDKPINTTLICNVTNALGARQAELTVQVKEGPPSEHSGISRN

SEQ ID NO: 1611 - protein, 323 aa, synthetic construct
  REGION 1..323: note = CD155 v145 ECD
WPPPGTGDLVVQAPTQVLGFLGDSVTLPCYLQVPNMEVTHVSQLTWARHGESGSVAVFHQTQGPSYSELKRLEFVAARPGEELRNASLRMSGLRVEDEGNYTCLFVMFPQGSRSVDIWLRVLAKPQNTAEVQKVQLTGEPVPMARCVSTGGRPPAQITWHSDLGGMPNTSQVPGFLSGTVTVTSLWILVPSSQVDGKNVTCKVEHESFEKPQLLTVNLTVYYPPEVSISGYDNNWYLGQNEATLTCDARSNPEPTGYNWSTTMGPLPPFAVAQGAQLLIRPVDKPINTTLICNVTNALGARQAELTVQVKEGPPSEHSGISRN

SEQ ID NO: 1612 - protein, 323 aa, synthetic construct
  REGION 1..323: note = CD155 v146 ECD
WPPPGTGDVVVQAPTQVFGFLGDSVTLPCYLQVPNMEVTQVSQLTWARHGESGSMAVFHQKKGPSYSESKRLEFVAARPGAELRNASLRMSGLRVEDEGNYTCMFVVFPQGSRSVDIWLRVLAKPQNTAEVQKVQLTGEPVPMARCVSTGGRPPAQITWHSDLGGMPNTSQVPGFLSGTVTVTSLWILVPSSQVDGKNVTCKVEHESFEKPQLLTVNLTVYYPPEVSISGYDNNWYLGQNEATLTCDARSNPEPTGYNWSTTMGPLPPFAVAQGAQLLIRPVDKPINTTLICNVTNALGARQAELTVQVKEGPPSEHSGISRN

SEQ ID NO: 1613 - protein, 323 aa, synthetic construct
  REGION 1..323: note = CD155 v147 ECD
WPPPGTGDVVVQAPTQVSGFLGDSVTLPCYLRVPNMEVTHVSQLTWARHGESGSMAVFHQTKGPSYSESKRLEFVAAGPGAELRNASLRMSGLRVEDEGNYTCLFVAFPQGSWSVDIWLRVLAKPQNTAEVQKVQLTGEPVPMARCVSTGGRPPAQITWHSDLGGMPNTSQVPGFLSGTVTVTSLWILVPSSQVDGKNVTCKVEHESFEKPQLLTVNLTVYYPPEVSISGYDNNWYLGQNEATLTCDARSNPEPTGYNWSTTMGPLPPFAVAQGAQLLIRPVDKPINTTLICNVTNALGARQAELTVQVKEGPPSEHSGISRN

SEQ ID NO: 1614 - protein, 323 aa, synthetic construct
  REGION 1..323: note = CD155 v148 ECD
WPPPGTGDVVVHAPTQVTGFSSDSVTLPCYLQVPNMEVTHVSQLTWARHGESGSMAAFHQTRGPSYSESKRLEFVAARPGAELRNASLRMSGLRVEDEGNYTCLFVMFPQGSRSVDIWLRVLAKPQNTAEVQKVQLTGEPVPMARCVSTGGRPPAQITWHSDLGGMPNTSQVPGFLSGTVTVTSLWILVPSSQVDGKNVTCKVEHESFEKPQLLTVNLTVYYPPEVSISGYDNNWYLGQNEATLTCDARSNPEPTGYNWSTTMGPLPPFAVAQGAQLLIRPVDKPINTTLICNVTNALGARQAELTVQVKEGPPSEHSGISRN

SEQ ID NO: 1615 - protein, 323 aa, synthetic construct
  REGION 1..323: note = CD155 v149 ECD
WPPPGTGDIVVQAPTQVSGFLGDPVTLPCYLQVPNMEVTHVSQLTWARQGESGSMAVYHRTKGPSYSESKRLEFVAARPGAELRNASLRMSGLRVEDEGNYTCLFVMFPQGSRSVDIWLRVLAKPQNTAEVQKVQLTGEPVPMARCVSTGGRPPAQITWHSDLGGMPNTSQVPGFLSGTVTVTSLWILVPSSQVDGKNVTCKVEHESFEKPQLLTVNLTVYYPPEVSISGYDNNWYLGQNEATLTCDARSNPEPTGYNWSTTMGPLPPFAVAQGAQLLIRPVDKPINTTLICNVTNALGARQAELTVQVKEGPPSEHSGISRN

SEQ ID NO: 1616 - protein, 323 aa, synthetic construct
  REGION 1..323: note = CD155 v150 ECD
WPPPGTGDVVVQAPTQVTGFLGDSVTLPCYLQVPNMEVTHVSQLTCARRGESGSMAVFHQTQGPAYVESKRLEFVTARPGAELRNATLRMFGLRVEDEGNYTCMFVTFPQGSRSVDIWLRVLAKPQNTAEVQKVQLTGEPVPMARCVSTGGRPPAQITWHSDLGGMPNTSQVPGFLSGTVTVTSLWILVPSSQVDGKNVTCKVEHESFEKPQLLTVNLTVYYPPEVSISGYDNNWYLGQNEATLTCDARSNPEPTGYNWSTTMGPLPPFAVAQGAQLLIRPVDKPINTTLICNVTNALGARQAELTVQVKEGPPSEHSGISRN

SEQ ID NO: 1617 - protein, 323 aa, synthetic construct
  REGION 1..323: note = CD155 v151 ECD
WPPPGTGDVVVQAPTQVSGFLGDSVTLPCYLQVPNMEVTHVTQLTWARHGGSGSMAVFHQTQGPSYSESKRLEFVAARPGAELRNASLRMSWLRVEDEGNYTCLFVMFPQGSRSVDIWLRVLAKPQNTAEVQKVQLTGEPVPMARCVSTGGRPPAQITWHSDLGGMPNTSQVPGFLSGTVTVTSLWILVPSSQVDGKNVTCKVEHESFEKPQLLTVNLTVYYPPEVSISGYDNNWYLGQNEATLTCDARSNPEPTGYNWSTTMGPLPPFAVAQGAQLLIRPVDKPINTTLICNVTNALGARQAELTVQVKEGPPSEHSGISRN

SEQ ID NO: 1618 - protein, 323 aa, synthetic construct
  REGION 1..323: note = CD155 v152 ECD
WPPPGTGDVFVQAPSQVLGFLGDSVTLPCYLQVPNMEVTHVSQLTWAQHGESGSMAVFHQTQGPSYSESKRLEFVAARPGAELRNASLRMSGLRVEDEGNYTCLFVMFPQGSRSMDIWLRVLAKPQNTAEVQKVQLTGEPVPMARCVSTGGRPPAQITWHSDLGGMPNTSQVPGFLSGTVTVTSLWILVPSSQVDGKNVTCKVEHESFEKPQLLTVNLTVYYPPEVSISGYDNNWYLGQNEATLTCDARSNPEPTGYNWSTTMGPLPPFAVAQGAQLLIRPVDKPINTTLICNVTNALGARQAELTVQVKEGPPSEHSGISRN

SEQ ID NO: 1619 - protein, 323 aa, synthetic construct
  REGION 1..323: note = CD155 v153 ECD
WPPPGTGDVVVQAPTQVSGFMGDSVTLPCFLQVPDMEVTHVSQLTWARHGESGSMAVFHQTQGPSYSESKRLEFVAARLGAELWNASLRMSGLRVEDEGNYTCLFVMFPQGSRSVGIWLRVLAKPQNTAEVQKVQLTGEPVPMARCVSTGGRPPAQITWHSDLGGMPNTSQVPGFLSGTVTVTSLWILVPSSQVDGKNVTCKVEHESFEKPQLLTVNLTVYYPPEVSISGYDNNWYLGQNEATLTCDARSNPEPTGYNWSTTMGPLPPFAVAQGAQLLIRPVDKPINTTLICNVTNALGARQAELTVQVKEGPPSEHSGISRN

SEQ ID NO: 1620 - protein, 323 aa, synthetic construct
  REGION 1..323: note = CD155 v154 ECD
WPPPGTGDVVVQAPTQVFGFLGDSVTLPCYLQVPNMEVTHVSQLTWARHGVSGGMAVFHRTQGPSYSESKRLEFVAARQGAGLRNATLRISRLRVEDEGNYTCLFVMFPQGSRSVDIWLRVLAKPQNTAEVQKVQLTGEPVPMARCVSTGGRPPAQITWHSDLGGMPNTSQVPGFLSGTVTVTSLWILVPSSQVDGKNVTCKVEHESFEKPQLLTVNLTVYYPPEVSISGYDNNWYLGQNEATLTCDARSNPEPTGYNWSTTMGPLPPFAVAQGAQLLIRPVDKPINTTLICNVTNALGARQAELTVQVKEGPPSEHSGISRN

SEQ ID NO: 1621 - protein, 323 aa, synthetic construct
  REGION 1..323: note = CD155 v155 ECD
WPPPGTGDVVVQAPTHVFGFLGDSVTLPCYLQVPNMEVTHVSQLTWARHGESGSMAVFHQTQGPSYSESKRLEFVAARLGAELRNASLRMSGLRVEDEGNYTCLFVMFPQGSRSVDIWLRVLAKPQNTAEVQKVQLTGEPVPMARCVSTGGRPPAQITWHSDLGGMPNTSQVPGFLSGTVTVTSLWILVPSSQVDGKNVTCKVEHESFEKPQLLTVNLTVYYPPEVSISGYDNNWYLGQNEATLTCDARSNPEPTGYNWSTTMGPLPPFAVAQGAQLLIRPVDKPINTTLICNVTNALGARQAELTVQVKEGPPSEHSGISRN

SEQ ID NO: 1622 - protein, 323 aa, synthetic construct
  REGION 1..323: note = CD155 v156 ECD
WPPPGTGDVVVQAPTQVTGFLGGSVTLPCYLQVPNMEVTHVSQLTWARHGESGSMAVFHRTQGPSYLESKRLEFVAARPGAELRNASLRMSGLRVEDEGNYTCLFVMFPQGSRSADIWLRVLAKPQNTAEVQKVQLTGEPVPMARCVSTGGRPPAQITWHSDLGGMPNTSQVPGFLSGTVTVTSLWILVPSSQVDGKNVTCKVEHESFEKPQLLTVNLTVYYPPEVSISGYDNNWYLGQNEATLTCDARSNPEPTGYNWSTTMGPLPPFAVAQGAQLLIRPVDKPINTTLICNVTNALGARQAELTVQVKEGPPSEHSGISRN

SEQ ID NO: 1623 - protein, 323 aa, synthetic construct
  REGION 1..323: note = CD155 v157 ECD
WPPPGTGGIVAQAPTQVTGFLGDSVMLPCYLQVPNMEVTHVSQLTWARHGEPGSMAVFHQTQGPSYSESKRLEFVAARPGAELRNASLRMSALRVEDEGNYTCLFVLFPQGSRSADIWLRVLAKPQNTAEVQKVQLTGEPVPMARCVSTGGRPPAQITWHSDLGGMPNTSQVPGFLSGTVTVTSLWILVPSSQVDGKNVTCKVEHESFEKPQLLTVNLTVYYPPEVSISGYDNNWYLGQNEATLTCDARSNPEPTGYNWSTTMGPLPPFAVAQGAQLLIRPVDKPINTTLICNVTNALGARQAELTVQVKEGPPSEHSGISRN

SEQ ID NO: 1624 - protein, 323 aa, synthetic construct
  REGION 1..323: note = CD155 v158 ECD
WPPPGTGDIVVQAPTQVFGFLGDSVTLPCYLQVPNMEVTHVSQLTWERHSESGSMAVFHQTQGPSYSGSKRLEFVAARPGAELRNASLRMSGLRVEDEGNYTCLFVMFPQGSRSVDIWLRVLAKPQNTAEVQKVQLTGEPVPMARCVSTGGRPPAQITWHSDLGGMPNTSQVPGFLSGTVTVTSLWILVPSSQVDGKNVTCKVEHESFEKPQLLTVNLTVYYPPEVSISGYDNNWYLGQNEATLTCDARSNPEPTGYNWSTTMGPLPPFAVAQGAQLLIRPVDKPINTTLICNVTNALGARQAELTVQVKEGPPSEHSGISRN

SEQ ID NO: 1625 - protein, 323 aa, synthetic construct
  REGION 1..323: note = CD155 v159 ECD
WPPPGTGDVVVQAPTQVSGFLGDSVTLPCYLQVPNMEVTHVSQLTWARHGESGSIAVFHQTKGPSYSEPKRLEFVAARPGAELRNASLRMSGLRVEDEGNYTCLFVMFPQGSRSVDIWLRVLAKPQNTAEVQKVQLTGEPVPMARCVSTGGRPPAQITWHSDLGGMPNTSQVPGFLSGTVTVTSLWILVPSSQVDGKNVTCKVEHESFEKPQLLTVNLTVYYPPEVSISGYDNNWYLGQNEATLTCDARSNPEPTGYNWSTTMGPLPPFAVAQGAQLLIRPVDKPINTTLICNVTNALGARQAELTVQVKEGPPSEHSGISRN

SEQ ID NO: 1626 - protein, 323 aa, synthetic construct
  REGION 1..323: note = CD155 v160 ECD
WPPPGTGDVVVQAPTQVTGFLGDSVTLPCYLQVPNMEVSHVSQLTWARHGEPGRMAVFHQTQGPSYSESKRLEFVAARPGAELRNASLRMSGLRVEDEGNYTCLFVMFPQGSRSVDIWLRVLAKPQNTAEVQKVQLTGEPVPMARCVSTGGRPPAQITWHSDLGGMPNTSQVPGFLSGTVTVTSLWILVPSSQVDGKNVTCKVEHESFEKPQLLTVNLTVYYPPEVSISGYDNNWYLGQNEATLTCDARSNPEPTGYNWSTTMGPLPPFAVAQGAQLLIRPVDKPINTTLICNVTNALGARQAELTVQVKEGPPSEHSGISRN

SEQ ID NO: 1627 - protein, 323 aa, synthetic construct
  REGION 1..323: note = CD155 v161 ECD
WPPPGTGDVVVQAPTQVSGFLGNSVTLPCYLQVPNMEVTHVSQLTWARHGESGSMAVFHQTQGPSYSESKRLEFVAARPGAELRNASLRMSGLRVEDEGNYTCLFVMFPQGSRNVDIWLRVLAKPQNTAEVQKVQLTGEPVPMARCVSTGGRPPAQITWHSDLGGMPNTSQVPGFLSGTVTVTSLWILVPSSQVDGKNVTCKVEHESFEKPQLLTVNLTVYYPPEVSISGYDNNWYLGQNEATLTCDARSNPEPTGYNWSTTMGPLPPFAVAQGAQLLIRPVDKPINTTLICNVTNALGARQAELTVQVKEGPPSEHSGISRN

SEQ ID NO: 1628 - protein, 323 aa, synthetic construct
  REGION 1..323: note = CD155 v162 ECD
WPPPGTGDVVVQAPTQVSGFLGDSVTLPCYLQVSNMEVTHVSQLTWARHGVSGSMAVFHQTQGPSYSESKRLEFVAARPGAELRNASLRMSGLRVEDEGNYTCLFVTFPQRSRSVDIWLRVLAKPQNTAEVQKVQLTGEPVPMARCVSTGGRPPAQITWHSDLGGMPNTSQVPGFLSGTVTVTSLWILVPSSQVDGKNVTCKVEHESFEKPQLLTVNLTVYYPPEVSISGYDNNWYLGQNEATLTCDARSNPEPTGYNWSTTMGPLPPFAVAQGAQLLIRPVDKPINTTLICNVTNALGARQAELTVQVKEGPPSEHSGISRN

SEQ ID NO: 1629 - protein, 323 aa, synthetic construct
  REGION 1..323: note = CD155 v163 ECD
WPPPGTGDVVVQAPTQVSGFLGDSVTLPCYLQVPNMEVTHVSQLTWARHGESGSMAVFNQTQGPSYSESKRLEFAAARPGTELRNASLRMSGLRVEDEGNYTCMFVMFPQGSRSVDIWLRVLAKPQNTAEVQKVQLTGEPVPMARCVSTGGRPPAQITWHSDLGGMPNTSQVPGFLSGTVTVTSLWILVPSSQVDGKNVTCKVEHESFEKPQLLTVNLTVYYPPEVSISGYDNNWYLGQNEATLTCDARSNPEPTGYNWSTTMGPLPPFAVAQGAQLLIRPVDKPINTTLICNVTNALGARQAELTVQVKEGPPSEHSGISRN

SEQ ID NO: 1630 - protein, 323 aa, synthetic construct
  REGION 1..323: note = CD155 v164 ECD
WPPPGTGDVVVQAPTQVSGFLGDSVTLPCYLQVPNMEVTHVSQLTRARHGESGSMAVFHQTQGPSYSDSKRLEFVAARPGAELRNASLRMSGLRVEDEGNYTCLFVMFPQGSGSVDIWLRVLAKPQNTAEVQKVQLTGEPVPMARCVSTGGRPPAQITWHSDLGGMPNTSQVPGFLSGTVTVTSLWILVPSSQVDGKNVTCKVEHESFEKPQLLTVNLTVYYPPEVSISGYDNNWYLGQNEATLTCDARSNPEPTGYNWSTTMGPLPPFAVAQGAQLLIRPVDKPINTTLICNVTNALGARQAELTVQVKEGPPSEHSGISRN

SEQ ID NO: 1631 - protein, 323 aa, synthetic construct
  REGION 1..323: note = CD155 v165 ECD
WPPPGTGDLVVQAPTQVFGFLGDSVTLPCYLQVPNMEVTHVSQLAWARHGESGSMAVFHQTQGPAYVESKRLEFVAAKVGAELRNASLRMSGLRVEDEGNYTCLFVMFPQGSRTVDIWLRVLAKPQNTAEVQKVQLTGEPVPMARCVSTGGRPPAQITWHSDLGGMPNTSQVPGFLSGTVTVTSLWILVPSSQVDGKNVTCKVEHESFEKPQLLTVNLTVYYPPEVSISGYDNNWYLGQNEATLTCDARSNPEPTGYNWSTTMGPLPPFAVAQGAQLLIRPVDKPINTTLICNVTNALGARQAELTVQVKEGPPSEHSGISRN

SEQ ID NO: 1632 - protein, 323 aa, synthetic construct
  REGION 1..323: note = CD155 v166 ECD
WPPPGTGDVVVQAPTQVTGFLGDSVTLPCYLQVPNMEVTHVSQLTWARHGESGSLAVFHQRQGPSYSESKRLEFVAARPGAELRNASLRMSGLRVEDEGNYTCLFIMFPQGSRSVDIWLRVLAKPQNTAEVQKVQLTGEPVPMARCVSTGGRPPAQITWHSDLGGMPNTSQVPGFLSGTVTVTSLWILVPSSQVDGKNVTCKVEHESFEKPQLLTVNLTVYYPPEVSISGYDNNWYLGQNEATLTCDARSNPEPTGYNWSTTMGPLPPFAVAQGAQLLIRPVDKPINTTLICNVTNALGARQAELTVQVKEGPPSEHSGISRN

SEQ ID NO: 1633 - protein, 323 aa, synthetic construct
  REGION 1..323: note = CD155 v167 ECD
WPPPGTGDVVVQAPIQVSGFLGDSVTLPCYLQMPFMEVSHVSQLTWARHGESGSLAVFHQTQGPSYSESKRLEFVAASPGAELRNASLRMSGLRVEDEGNYTCLFVMFPQGSRSVDIWLRVLAKPQNTAEVQKVQLTGEPVPMARCVSTGGRPPAQITWHSDLGGMPNTSQVPGFLSGTVTVTSLWILVPSSQVDGKNVTCKVEHESFEKPQLLTVNLTVYYPPEVSISGYDNNWYLGQNEATLTCDARSNPEPTGYNWSTTMGPLPPFAVAQGAQLLIRPVDKPINTTLICNVTNALGARQAELTVQVKEGPPSEHSGISRN

SEQ ID NO: 1634 - protein, 323 aa, synthetic construct
  REGION 1..323: note = CD155 v168 ECD
WPPPGTGDVVVQAPTQVSGFLGDSVTLPCYLQVPNMEVTHVSQLTWARHGESGSMAVFHQTKGPSYSESERLEFVAARPGAELRNASLRMSELRVEDEGNYTCLFVTFPQGSWSVDIWLRVLAKPQNTAEVQKVQLTGEPVPMARCVSTGGRPPAQITWHSDLGGMPNTSQVPGFLSGTVTVTSLWILVPSSQVDGKNVTCKVEHESFEKPQLLTVNLTVYYPPEVSISGYDNNWYLGQNEATLTCDARSNPEPTGYNWSTTMGPLPPFAVAQGAQLLIRPVDKPINTTLICNVTNALGARQAELTVQVKEGPPSEHSGISRN

SEQ ID NO: 1635 - protein, 323 aa, synthetic construct
  REGION 1..323: note = CD155 v169 ECD
WPPPGTGDVVVQAPTQVFGILGDSVMLPCYLQVPNMEVTHVSQLTWVRHGKSGSMAVFHQTQGPSYSESKRLEFVAARPGAELRNASLRMSGLRVEDEGNYTCLFVTFPQGSRSVDIWLRVLAKPQNTAEVQKVQLTGEPVPMARCVSTGGRPPAQITWHSDLGGMPNTSQVPGFLSGTVTVTSLWILVPSSQVDGKNVTCKVEHESFEKPQLLTVNLTVYYPPEVSISGYDNNWYLGQNEATLTCDARSNPEPTGYNWSTTMGPLPPFAVAQGAQLLIRPVDKPINTTLICNVTNALGARQAELTVQVKEGPPSEHSGISRN

SEQ ID NO: 1636 - protein, 323 aa, synthetic construct
  REGION 1..323: note = CD155 v170 ECD
WPPPGTGDVVVQAPTQVTGFLGASVTLPCYLQVPNMEVTHVSQLTWARHGESGSMAVFHHTQGPSYSESKRLEFVAARPGAELRNASLRVSGLRVEDEGNYTCLFVMFPQGSRSVDIWLRVLAKPQNTAEVQKVQLTGEPVPMARCVSTGGRPPAQITWHSDLGGMPNTSQVPGFLSGTVTVTSLWILVPSSQVDGKNVTCKVEHESFEKPQLLTVNLTVYYPPEVSISGYDNNWYLGQNEATLTCDARSNPEPTGYNWSTTMGPLPPFAVAQGAQLLIRPVDKPINTTLICNVTNALGARQAELTVQVKEGPPSEHSGISRN

SEQ ID NO: 1637 - protein, 323 aa, synthetic construct
  REGION 1..323: note = CD155 v171 ECD
WPPPGTGDVVVQAPTQVSGFLGGSVTLPRYLQVPDMGVTHVSQLTWARHGESGSIAVFHQTKGPAYGESKRLEFVAAGPGAELRNASLRMSGLRVEDEGNYTCMFVMFPRGSRSVDIWLRVLAKPQNTAEVQKVQLTGEPVPMARCVSTGGRPPAQITWHSDLGGMPNTSQVPGFLSGTVTVTSLWILVPSSQVDGKNVTCKVEHESFEKPQLLTVNLTVYYPPEVSISGYDNNWYLGQNEATLTCDARSNPEPTGYNWSTTMGPLPPFAVAQGAQLLIRPVDKPINTTLICNVTNALGARQAELTVQVKEGPPSEHSGISRN

SEQ ID NO: 1638 - protein, 323 aa, synthetic construct
  REGION 1..323: note = CD155 v172 ECD
WPPPGTGDVVVQEPTQVSGFLGDSVTLPCYLQVPNREVTHVSQLTWARHGESGSMAVFHQTKGPSYTESKRLEFVAARPGAELRDASLRMSGLRVEDEGNYTCLFVMFPQGSRSVDIWLRVLAKPQNTAEVQKVQLTGEPVPMARCVSTGGRPPAQITWHSDLGGMPNTSQVPGFLSGTVTVTSLWILVPSSQVDGKNVTCKVEHESFEKPQLLTVNLTVYYPPEVSISGYDNNWYLGQNEATLTCDARSNPEPTGYNWSTTMGPLPPFAVAQGAQLLIRPVDKPINTTLICNVTNALGARQAELTVQVKEGPPSEHSGISRN

SEQ ID NO: 1639 - protein, 323 aa, synthetic construct
  REGION 1..323: note = CD155 v173 ECD
WPPPGTGDIVVQAPTQVTGFLGDSVTLPCYLQVPNMEVTHVSQLTWARRGESGSMAVFHQTQGPSYSESKRLEFVAARPGAELRDASLRMSGLRVEDEGNYTCTFVMFPQGSRSVDIWLRVLAKPQNTAEVQKVQLTGEPVPMARCVSTGGRPPAQITWHSDLGGMPNTSQVPGFLSGTVTVTSLWILVPSSQVDGKNVTCKVEHESFEKPQLLTVNLTVYYPPEVSISGYDNNWYLGQNEATLTCDARSNPEPTGYNWSTTMGPLPPFAVAQGAQLLIRPVDKPINTTLICNVTNALGARQAELTVQVKEGPPSEHSGISRN

SEQ ID NO: 1640 - protein, 323 aa, synthetic construct
  REGION 1..323: note = CD155 v174 ECD
WPPPGTGDAVVQAPTQVFGFLGDSVTLPCYLQVPNMEVTHVSQLTWARHGESGSMAVFHQSLGPSYSESKRLEFVAARPGAELRNASLRMSGLRVEDEGNYTCLFVTFPQRSRSVDIWLRVLAKPQNTAEVQKVQLTGEPVPMARCVSTGGRPPAQITWHSDLGGMPNTSQVPGFLSGTVTVTSLWILVPSSQVDGKNVTCKVEHESFEKPQLLTVNLTVYYPPEVSISGYDNNWYLGQNEATLTCDARSNPEPTGYNWSTTMGPLPPFAVAQGAQLLIRPVDKPINTTLICNVTNALGARQAELTVQVKEGPPSEHSGISRN

SEQ ID NO: 1641 - protein, 323 aa, synthetic construct
  REGION 1..323: note = CD155 v175 ECD
WPPPGTGEVVVQAPTQVTGFLGDSVTLPCYLQVPNMEVTHVSQLTWARHGESGSMAVFHQAQGPSYSESKRLEFVAARPGAELRNASLRMSGLRVEDEGNYTCLFVMFPQGSRSVDIWLRVLAKPQNTAEVQKVQLTGEPVPMARCVSTGGRPPAQITWHSDLGGMPNTSQVPGFLSGTVTVTSLWILVPSSQVDGKNVTCKVEHESFEKPQLLTVNLTVYYPPEVSISGYDNNWYLGQNEATLTCDARSNPEPTGYNWSTTMGPLPPFAVAQGAQLLIRPVDKPINTTLICNVTNALGARQAELTVQVKEGPPSEHSGISRN

SEQ ID NO: 1642 - protein, 323 aa, synthetic construct
  REGION 1..323: note = CD155 v176 ECD
WPPPGTGDVVVQAPTQVSGFLGDSVTLPCYLQVPNMEVTHASQLTWARRGESGCMAVFHQTQGPSYSESKRLEFVAARSGAELRYASPRMSGLRVEDEGNYTCMFVMFPQGSRSVDIWLRVLAKPQNTAEVQKVQLTGEPVPMARCVSTGGRPPAQITWHSDLGGMPNTSQVPGFLSGTVTVTSLWILVPSSQVDGKNVTCKVEHESFEKPQLLTVNLTVYYPPEVSISGYDNNWYLGQNEATLTCDARSNPEPTGYNWSTTMGPLPPFAVAQGAQLLIRPVDKPINTTLICNVTNALGARQAELTVQVKEGPPSEHSGISRN

SEQ ID NO: 1643 - protein, 323 aa, synthetic construct
  REGION 1..323: note = CD155 v177 ECD
WPPPGTGDVVEQAPTQVHGYLGDSETLPCYLQVPSMEVTHVSQLTWARRGESGSMAVFHQTQGPSYSESKRLEFVAARPGAELRNASLRMSGLRVEDEGNYTCLFVMFPQRSRSVDIWLRVLAKPQNTAEVQKVQLTGEPVPMARCVSTGGRPPAQITWHSDLGGMPNTSQVPGFLSGTVTVTSLWILVPSSQVDGKNVTCKVEHESFEKPQLLTVNLTVYYPPEVSISGYDNNWYLGQNEATLTCDARSNPEPTGYNWSTTMGPLPPFAVAQGAQLLIRPVDKPINTTLICNVTNALGARQAELTVQVKEGPPSEHSGISRN

SEQ ID NO: 1644 - protein, 323 aa, synthetic construct
  REGION 1..323: note = CD155 v178 ECD
WPPPGTGDVVAQAPTQVFGFLGASVTLPCYLQVPNMEVTHVSQLTWARHGESGSMAVFHQTQGPSYSESKRLEFVAARPDAELRNASLRMFGLRAEDEGNYTCLFVMFPQGSRSVDIWLRVLAKPQNTAEVQKVQLTGEPVPMARCVSTGGRPPAQITWHSDLGGMPNTSQVPGFLSGTVTVTSLWILVPSSQVDGKNVTCKVEHESFEKPQLLTVNLTVYYPPEVSISGYDNNWYLGQNEATLTCDARSNPEPTGYNWSTTMGPLPPFAVAQGAQLLIRPVDKPINTTLICNVTNALGARQAELTVQVKEGPPSEHSGISRN

SEQ ID NO: 1645 - protein, 323 aa, synthetic construct
  REGION 1..323: note = CD155 v179 ECD
WPPPGTGDVVVQAPTQVSGFLGDSVTLPCYLQVPNMEVTHVSQLTWARHGESGSMAVFHQTQGPSYSESRRLEFVAARPGAELRNASLRMSGLRVEDEGNYTCLFVTFPQRSRSVDIWLRVLAKPQNTAEVQKVQLTGEPVPMARCVSTGGRPPAQITWHSDLGGMPNTSQVPGFLSGTVTVTSLWILVPSSQVDGKNVTCKVEHESFEKPQLLTVNLTVYYPPEVSISGYDNNWYLGQNEATLTCDARSNPEPTGYNWSTTMGPLPPFAVAQGAQLLIRPVDKPINTTLICNVTNALGARQAELTVQVKEGPPSEHSGISRN

SEQ ID NO: 1646 - protein, 323 aa, synthetic construct
  REGION 1..323: note = CD155 v180 ECD
WPPPGTGDLVMQAPTQVSGFLGDSVTLPCYLQVPSMEVTHVSQLTWARHGESGGMAVFHQTKGPSYSESKRLEFVAARPGAELRNASLRMFGLRVEDEGNYTCMFVMFPQGSRSMDIWLRVLAKPQNTAEVQKVQLTGEPVPMARCVSTGGRPPAQITWHSDLGGMPNTSQVPGFLSGTVTVTSLWILVPSSQVDGKNVTCKVEHESFEKPQLLTVNLTVYYPPEVSISGYDNNWYLGQNEATLTCDARSNPEPTGYNWSTTMGPLPPFAVAQGAQLLIRPVDKPINTTLICNVTNALGARQAELTVQVKEGPPSEHSGISRN

SEQ ID NO: 1647 - protein, 323 aa, synthetic construct
  REGION 1..323: note = CD155 v181 ECD
WPPPGTGDLVVQAPTQVYGFLGDSATLPCYLQVPNMEGTHVSQLTWARHGESGSVAVFHQTQGPSYSESKRLEFVATRPGAELRNASLRISGLRVEDEGNYTCMFVTFPQGSRSVDIWLRVLAKPQNTAEVQKVQLTGEPVPMARCVSTGGRPPAQITWHSDLGGMPNTSQVPGFLSGTVTVTSLWILVPSSQVDGKNVTCKVEHESFEKPQLLTVNLTVYYPPEVSISGYDNNWYLGQNEATLTCDARSNPEPTGYNWSTTMGPLPPFAVAQGAQLLIRPVDKPINTTLICNVTNALGARQAELTVQVKEGPPSEHSGISRN

SEQ ID NO: 1648 - protein, 323 aa, synthetic construct
  REGION 1..323: note = CD155 v182 ECD
WPPPGTGDVGVQAPTQVTGFLGDSVTLPCYLQVPNMEVTHVSQLTWARHGESGSMAVFHQTQGPSYSESKRQEFVAARPGAELRNASLRMSGLRVEDEGNYTCLFVMFPQGSRSVDIWLRVLAKPQNTAEVQKVQLTGEPVPMARCVSTGGRPPAQITWHSDLGGMPNTSQVPGFLSGTVTVTSLWILVPSSQVDGKNVTCKVEHESFEKPQLLTVNLTVYYPPEVSISGYDNNWYLGQNEATLTCDARSNPEPTGYNWSTTMGPLPPFAVAQGAQLLIRPVDKPINTTLICNVTNALGARQAELTVQVKEGPPSEHSGISRN

SEQ ID NO: 1649 - protein, 323 aa, synthetic construct
  REGION 1..323: note = CD155 v183 ECD
WPPPGTGDVVVQAPTQVSGFLGDSVTLPCYLQVPNMEVTHVSQLTWARHGESGSMAVFRQTQGPSYSESKRLEFVGASPGAELRNASLRMFGLRVEDEGNYTCLFVTFPQGSRSVDIWLRVLAKPQNTAEVQKVQLTGEPVPMARCVSTGGRPPAQITWHSDLGGMPNTSQVPGFLSGTVTVTSLWILVPSSQVDGKNVTCKVEHESFEKPQLLTVNLTVYYPPEVSISGYDNNWYLGQNEATLTCDARSNPEPTGYNWSTTMGPLPPFAVAQGAQLLIRPVDKPINTTLICNVTNALGARQAELTVQVKEGPPSEHSGISRN

SEQ ID NO: 1650 - protein, 323 aa, synthetic construct
  REGION 1..323: note = CD155 v184 ECD
WPPPGTGDAVVQAPTQVSGFLGDSVTLPCYLQVPNTEVTHVSQLTWARHGESGSMAVFHQTQGPGYSESKRLEFVAARPGAELRNASLRMSGLRVEDEGNYTCTFVTFPQRIRSVDIWLRVLAKPQNTAEVQKVQLTGEPVPMARCVSTGGRPPAQITWHSDLGGMPNTSQVPGFLSGTVTVTSLWILVPSSQVDGKNVTCKVEHESFEKPQLLTVNLTVYYPPEVSISGYDNNWYLGQNEATLTCDARSNPEPTGYNWSTTMGPLPPFAVAQGAQLLIRPVDKPINTTLICNVTNALGARQAELTVQVKEGPPSEHSGISRN

SEQ ID NO: 1651 - protein, 323 aa, synthetic construct
  REGION 1..323: note = CD155 v185 ECD
WPPPGTGDVVVQAPTQVTGFLGDSVTLPCYLQVPNMEVTHVSQLTWARHGEAGSMAAFHRTKGPCYSESKRLEFVAARPGAELRNASLRMTGLRVEDEGYYTCLFVMFPQGSRSVDIWLRVLAKPQNTAEVQKVQLTGEPVPMARCVSTGGRPPAQITWHSDLGGMPNTSQVPGFLSGTVTVTSLWILVPSSQVDGKNVTCKVEHESFEKPQLLTVNLTVYYPPEVSISGYDNNWYLGQNEATLTCDARSNPEPTGYNWSTTMGPLPPFAVAQGAQLLIRPVDKPINTTLICNVTNALGARQAELTVQVKEGPPSEHSGISRN

SEQ ID NO: 1652 - protein, 323 aa, synthetic construct
  REGION 1..323: note = CD155 v186 ECD
WPPPGTGDVVAQAPTQVFGFLGDSVTLPCYLQVPDMEVTHVSQLTWERHGESGSMAVFHQTKGPSYSESKRLEFVAARPGAELRNASLRMSGLRVEDEDNYTCLFVMFPQGSRNVDIWLRVLAKPQNTAEVQKVQLTGEPVPMARCVSTGGRPPAQITWHSDLGGMPNTSQVPGFLSGTVTVTSLWILVPSSQVDGKNVTCKVEHESFEKPQLLTVNLTVYYPPEVSISGYDNNWYLGQNEATLTCDARSNPEPTGYNWSTTMGPLPPFAVAQGAQLLIRPVDKPINTTLICNVTNALGARQAELTVQVKEGPPSEHSGISRN

SEQ ID NO: 1653 - protein, 323 aa, synthetic construct
  REGION 1..323: note = CD155 v187 ECD
WPPPGTGDVVAQAPTQVTGFLGDSVTLPCYLQVPSMEVTHVSQLTWARHGESGSMAVFHQTQGPSYSESKRLEFVAARPGAELRNATLRMSGLRVEDEGNYTCLFVTFPQGSRSVDIWLRVLAKPQNTAEVQKVQLTGEPVPMARCVSTGGRPPAQITWHSDLGGMPNTSQVPGFLSGTVTVTSLWILVPSSQVDGKNVTCKVEHESFEKPQLLTVNLTVYYPPEVSISGYDNNWYLGQNEATLTCDARSNPEPTGYNWSTTMGPLPPFAVAQGAQLLIRPVDKPINTTLICNVTNALGARQAELTVQVKEGPPSEHSGISRN

SEQ ID NO: 1654 - protein, 323 aa, synthetic construct
  REGION 1..323: note = CD155 v188 ECD
WPPPGTGDDVMLAPTQVSGFLGDSVTLPCYLQVPNMVVTHVSQLTWARHGESGSIAVFHRTQGPSYSESQRLEFVAARPGAELRNASLRMSGLRVEDEGNYTCMFVMFPQGSRSVDIWLRVLAKPQNTAEVQKVQLTGEPVPMARCVSTGGRPPAQITWHSDLGGMPNTSQVPGFLSGTVTVTSLWILVPSSQVDGKNVTCKVEHESFEKPQLLTVNLTVYYPPEVSISGYDNNWYLGQNEATLTCDARSNPEPTGYNWSTTMGPLPPFAVAQGAQLLIRPVDKPINTTLICNVTNALGARQAELTVQVKEGPPSEHSGISRN

SEQ ID NO: 1655 - protein, 323 aa, synthetic construct
  REGION 1..323: note = CD155 v189 ECD
WPPPGTGDVVVQAPSQVSGFLGDSVTLPCHLLVPNMEVTHVSQLTWARHGESGSMAVFHQTRGPSYSESKRLEFVAARPGAELRNASLRMSGLRVEDEGNYTCLFVMFPQGSRSVDIWLRVLAKPQNTAEVQKVQLTGEPVPMARCVSTGGRPPAQITWHSDLGGMPNTSQVPGFLSGTVTVTSLWILVPSSQVDGKNVTCKVEHESFEKPQLLTVNLTVYYPPEVSISGYDNNWYLGQNEATLTCDARSNPEPTGYNWSTTMGPLPPFAVAQGAQLLIRPVDKPINTTLICNVTNALGARQAELTVQVKEGPPSEHSGISRN

SEQ ID NO: 1656 - protein, 116 aa, synthetic construct
  REGION 1..116: note = CD155 v144 IgV
PGTGDVVVQAPTQVTDFLGDSVTLPCYLQVPNTEVTHVSQLTWARHGESGNMAVFHQTQGPSYSESKRLEFVAARPGAEQRNASLRMSGLRVEDEGNYTCLFVMYPQGSRSVDIWL

SEQ ID NO: 1657 - protein, 116 aa, synthetic construct
  REGION 1..116: note = CD155 v145 IgV
PGTGDLVVQAPTQVLGFLGDSVTLPCYLQVPNMEVTHVSQLTWARHGESGSVAVFHQTQGPSYSELKRLEFVAARPGEELRNASLRMSGLRVEDEGNYTCLFVMFPQGSRSVDIWL

SEQ ID NO: 1658 - protein, 116 aa, synthetic construct
  REGION 1..116: note = CD155 v146 IgV
PGTGDVVVQAPTQVFGFLGDSVTLPCYLQVPNMEVTQVSQLTWARHGESGSMAVFHQKKGPSYSESKRLEFVAARPGAELRNASLRMSGLRVEDEGNYTCMFVVFPQGSRSVDIWL

SEQ ID NO: 1659 - protein, 116 aa, synthetic construct
  REGION 1..116: note = CD155 v147 IgV
PGTGDVVVQAPTQVSGFLGDSVTLPCYLRVPNMEVTHVSQLTWARHGESGSMAVFHQTKGPSYSESKRLEFVAAGPGAELRNASLRMSGLRVEDEGNYTCLFVAFPQGSWSVDIWL

SEQ ID NO: 1660 - protein, 116 aa, synthetic construct
  REGION 1..116: note = CD155 v148 IgV
PGTGDVVVHAPTQVTGFSSDSVTLPCYLQVPNMEVTHVSQLTWARHGESGSMAAFHQTRGPSYSESKRLEFVAARPGAELRNASLRMSGLRVEDEGNYTCLFVMFPQGSRSVDIWL

SEQ ID NO: 1661 - protein, 116 aa, synthetic construct
  REGION 1..116: note = CD155 v149 IgV
PGTGDIVVQAPTQVSGFLGDPVTLPCYLQVPNMEVTHVSQLTWARQGESGSMAVYHRTKGPSYSESKRLEFVAARPGAELRNASLRMSGLRVEDEGNYTCLFVMFPQGSRSVDIWL

SEQ ID NO: 1662 - protein, 116 aa, synthetic construct
  REGION 1..116: note = CD155 v150 IgV
PGTGDVVVQAPTQVTGFLGDSVTLPCYLQVPNMEVTHVSQLTCARRGESGSMAVFHQTQGPAYVESKRLEFVTARPGAELRNATLRMFGLRVEDEGNYTCMFVTFPQGSRSVDIWL

SEQ ID NO: 1663 - protein, 116 aa, synthetic construct
  REGION 1..116: note = CD155 v151 IgV
PGTGDVVVQAPTQVSGFLGDSVTLPCYLQVPNMEVTHVTQLTWARHGGSGSMAVFHQTQGPSYSESKRLEFVAARPGAELRNASLRMSWLRVEDEGNYTCLFVMFPQGSRSVDIWL

SEQ ID NO: 1664 - protein, 116 aa, synthetic construct
  REGION 1..116: note = CD155 v152 IgV
PGTGDVFVQAPSQVLGFLGDSVTLPCYLQVPNMEVTHVSQLTWAQHGESGSMAVFHQTQGPSYSESKRLEFVAARPGAELRNASLRMSGLRVEDEGNYTCLFVMFPQGSRSMDIWL

SEQ ID NO: 1665 - protein, 116 aa, synthetic construct
  REGION 1..116: note = CD155 v153 IgV
PGTGDVVVQAPTQVSGFMGDSVTLPCFLQVPDMEVTHVSQLTWARHGESGSMAVFHQTQGPSYSESKRLEFVAARLGAELWNASLRMSGLRVEDEGNYTCLFVMFPQGSRSVGIWL

SEQ ID NO: 1666 - protein, 116 aa, synthetic construct
  REGION 1..116: note = CD155 v154 IgV
PGTGDVVVQAPTQVFGFLGDSVTLPCYLQVPNMEVTHVSQLTWARHGVSGGMAVFHRTQGPSYSESKRLEFVAARQGAGLRNATLRISRLRVEDEGNYTCLFVMFPQGSRSVDIWL

SEQ ID NO: 1667 - protein, 116 aa, synthetic construct
  REGION 1..116: note = CD155 v155 IgV
PGTGDVVVQAPTHVFGFLGDSVTLPCYLQVPNMEVTHVSQLTWARHGESGSMAVFHQTQGPSYSESKRLEFVAARLGAELRNASLRMSGLRVEDEGNYTCLFVMFPQGSRSVDIWL

SEQ ID NO: 1668 - protein, 116 aa, synthetic construct
  REGION 1..116: note = CD155 v156 IgV
PGTGDVVVQAPTQVTGFLGGSVTLPCYLQVPNMEVTHVSQLTWARHGESGSMAVFHRTQGPSYLESKRLEFVAARPGAELRNASLRMSGLRVEDEGNYTCLFVMFPQGSRSADIWL

SEQ ID NO: 1669 - protein, 116 aa, synthetic construct
  REGION 1..116: note = CD155 v157 IgV
PGTGGIVAQAPTQVTGFLGDSVMLPCYLQVPNMEVTHVSQLTWARHGEPGSMAVFHQTQGPSYSESKRLEFVAARPGAELRNASLRMSALRVEDEGNYTCLFVLFPQGSRSADIWL

SEQ ID NO: 1670 - protein, 116 aa, synthetic construct
  REGION 1..116: note = CD155 v158 IgV
PGTGDIVVQAPTQVFGFLGDSVTLPCYLQVPNMEVTHVSQLTWERHSESGSMAVFHQTQGPSYSGSKRLEFVAARPGAELRNASLRMSGLRVEDEGNYTCLFVMFPQGSRSVDIWL

SEQ ID NO: 1671 - protein, 116 aa, synthetic construct
  REGION 1..116: note = CD155 v159 IgV
PGTGDVVVQAPTQVSGFLGDSVTLPCYLQVPNMEVTHVSQLTWARHGESGSIAVFHQTKGPSYSEPKRLEFVAARPGAELRNASLRMSGLRVEDEGNYTCLFVMFPQGSRSVDIWL

SEQ ID NO: 1672 - protein, 116 aa, synthetic construct
  REGION 1..116: note = CD155 v160 IgV
PGTGDVVVQAPTQVTGFLGDSVTLPCYLQVPNMEVSHVSQLTWARHGEPGRMAVFHQTQGPSYSESKRLEFVAARPGAELRNASLRMSGLRVEDEGNYTCLFVMFPQGSRSVDIWL

SEQ ID NO: 1673 - protein, 116 aa, synthetic construct
  REGION 1..116: note = CD155 v161 IgV
PGTGDVVVQAPTQVSGFLGNSVTLPCYLQVPNMEVTHVSQLTWARHGESGSMAVFHQTQGPSYSESKRLEFVAARPGAELRNASLRMSGLRVEDEGNYTCLFVMFPQGSRNVDIWL

SEQ ID NO: 1674 - protein, 116 aa, synthetic construct
  REGION 1..116: note = CD155 v162 IgV
PGTGDVVVQAPTQVSGFLGDSVTLPCYLQVSNMEVTHVSQLTWARHGVSGSMAVFHQTQGPSYSESKRLEFVAARPGAELRNASLRMSGLRVEDEGNYTCLFVTFPQRSRSVDIWL

SEQ ID NO: 1675 - protein, 116 aa, synthetic construct
  REGION 1..116: note = CD155 v163 IgV
PGTGDVVVQAPTQVSGFLGDSVTLPCYLQVPNMEVTHVSQLTWARHGESGSMAVFNQTQGPSYSESKRLEFAAARPGTELRNASLRMSGLRVEDEGNYTCMFVMFPQGSRSVDIWL

SEQ ID NO: 1676 - protein, 116 aa, synthetic construct
  REGION 1..116: note = CD155 v164 IgV
PGTGDVVVQAPTQVSGFLGDSVTLPCYLQVPNMEVTHVSQLTRARHGESGSMAVFHQTQGPSYSDSKRLEFVAARPGAELRNASLRMSGLRVEDEGNYTCLFVMFPQGSGSVDIWL

SEQ ID NO: 1677 - protein, 116 aa, synthetic construct
  REGION 1..116: note = CD155 v165 IgV
PGTGDLVVQAPTQVFGFLGDSVTLPCYLQVPNMEVTHVSQLAWARHGESGSMAVFHQTQGPAYVESKRLEFVAAKVGAELRNASLRMSGLRVEDEGNYTCLFVMFPQGSRTVDIWL

SEQ ID NO: 1678 - protein, 116 aa, synthetic construct
  REGION 1..116: note = CD155 v166 IgV
PGTGDVVVQAPTQVTGFLGDSVTLPCYLQVPNMEVTHVSQLTWARHGESGSLAVFHQRQGPSYSESKRLEFVAARPGAELRNASLRMSGLRVEDEGNYTCLFIMFPQGSRSVDIWL

SEQ ID NO: 1679 - protein, 116 aa, synthetic construct
  REGION 1..116: note = CD155 v167 IgV
PGTGDVVVQAPIQVSGFLGDSVTLPCYLQMPFMEVSHVSQLTWARHGESGSLAVFHQTQGPSYSESKRLEFVAASPGAELRNASLRMSGLRVEDEGNYTCLFVMFPQGSRSVDIWL

SEQ ID NO: 1680 - protein, 116 aa, synthetic construct
  REGION 1..116: note = CD155 v168 IgV
PGTGDVVVQAPTQVSGFLGDSVTLPCYLQVPNMEVTHVSQLTWARHGESGSMAVFHQTKGPSYSESERLEFVAARPGAELRNASLRMSELRVEDEGNYTCLFVTFPQGSWSVDIWL

SEQ ID NO: 1681 - protein, 116 aa, synthetic construct
  REGION 1..116: note = CD155 v169 IgV
PGTGDVVVQAPTQVFGILGDSVMLPCYLQVPNMEVTHVSQLTWVRHGKSGSMAVFHQTQGPSYSESKRLEFVAARPGAELRNASLRMSGLRVEDEGNYTCLFVTFPQGSRSVDIWL

SEQ ID NO: 1682 - protein, 116 aa, synthetic construct
  REGION 1..116: note = CD155 v170 IgV
PGTGDVVVQAPTQVTGFLGASVTLPCYLQVPNMEVTHVSQLTWARHGESGSMAVFHHTQGPSYSESKRLEFVAARPGAELRNASLRVSGLRVEDEGNYTCLFVMFPQGSRSVDIWL

SEQ ID NO: 1683 - protein, 116 aa, synthetic construct
  REGION 1..116: note = CD155 v171 IgV
PGTGDVVVQAPTQVSGFLGGSVTLPRYLQVPDMGVTHVSQLTWARHGESGSIAVFHQTKGPAYGESKRLEFVAAGPGAELRNASLRMSGLRVEDEGNYTCMFVMFPRGSRSVDIWL

SEQ ID NO: 1684 - protein, 116 aa, synthetic construct
  REGION 1..116: note = CD155 v172 IgV
PGTGDVVVQEPTQVSGFLGDSVTLPCYLQVPNREVTHVSQLTWARHGESGSMAVFHQTKGPSYTESKRLEFVAARPGAELRDASLRMSGLRVEDEGNYTCLFVMFPQGSRSVDIWL

SEQ ID NO: 1685 - protein, 116 aa, synthetic construct
  REGION 1..116: note = CD155 v173 IgV
PGTGDIVVQAPTQVTGFLGDSVTLPCYLQVPNMEVTHVSQLTWARRGESGSMAVFHQTQGPSYSESKRLEFVAARPGAELRDASLRMSGLRVEDEGNYTCTFVMFPQGSRSVDIWL

SEQ ID NO: 1686 - protein, 116 aa, synthetic construct
  REGION 1..116: note = CD155 v174 IgV
PGTGDAVVQAPTQVFGFLGDSVTLPCYLQVPNMEVTHVSQLTWARHGESGSMAVFHQSLGPSYSESKRLEFVAARPGAELRNASLRMSGLRVEDEGNYTCLFVTFPQRSRSVDIWL

SEQ ID NO: 1687 - protein, 116 aa, synthetic construct
  REGION 1..116: note = CD155 v175 IgV
PGTGEVVVQAPTQVTGFLGDSVTLPCYLQVPNMEVTHVSQLTWARHGESGSMAVFHQAQGPSYSESKRLEFVAARPGAELRNASLRMSGLRVEDEGNYTCLFVMFPQGSRSVDIWL

SEQ ID NO: 1688 - protein, 116 aa, synthetic construct
  REGION 1..116: note = CD155 v176 IgV
PGTGDVVVQAPTQVSGFLGDSVTLPCYLQVPNMEVTHASQLTWARRGESGCMAVFHQTQGPSYSESKRLEFVAARSGAELRYASPRMSGLRVEDEGNYTCMFVMFPQGSRSVDIWL

SEQ ID NO: 1689 - protein, 116 aa, synthetic construct
  REGION 1..116: note = CD155 v177 IgV
PGTGDVVEQAPTQVHGYLGDSETLPCYLQVPSMEVTHVSQLTWARRGESGSMAVFHQTQGPSYSESKRLEFVAARPGAELRNASLRMSGLRVEDEGNYTCLFVMFPQRSRSVDIWL

SEQ ID NO: 1690 - protein, 116 aa, synthetic construct
  REGION 1..116: note = CD155 v178 IgV
PGTGDVVAQAPTQVFGFLGASVTLPCYLQVPNMEVTHVSQLTWARHGESGSMAVFHQTQGPSYSESKRLEFVAARPDAELRNASLRMFGLRAEDEGNYTCLFVMFPQGSRSVDIWL

SEQ ID NO: 1691 - protein, 116 aa, synthetic construct
  REGION 1..116: note = CD155 v179 IgV
PGTGDVVVQAPTQVSGFLGDSVTLPCYLQVPNMEVTHVSQLTWARHGESGSMAVFHQTQGPSYSESRRLEFVAARPGAELRNASLRMSGLRVEDEGNYTCLFVTFPQRSRSVDIWL

SEQ ID NO: 1692 - protein, 116 aa, synthetic construct
  REGION 1..116: note = CD155 v180 IgV
PGTGDLVMQAPTQVSGFLGDSVTLPCYLQVPSMEVTHVSQLTWARHGESGGMAVFHQTKGPSYSESKRLEFVAARPGAELRNASLRMFGLRVEDEGNYTCMFVMFPQGSRSMDIWL

SEQ ID NO: 1693 - protein, 116 aa, synthetic construct
  REGION 1..116: note = CD155 v181 IgV
PGTGDLVVQAPTQVYGFLGDSATLPCYLQVPNMEGTHVSQLTWARHGESGSVAVFHQTQGPSYSESKRLEFVATRPGAELRNASLRISGLRVEDEGNYTCMFVTFPQGSRSVDIWL

SEQ ID NO: 1694 - protein, 116 aa, synthetic construct
  REGION 1..116: note = CD155 v182 IgV
PGTGDVGVQAPTQVTGFLGDSVTLPCYLQVPNMEVTHVSQLTWARHGESGSMAVFHQTQGPSYSESKRQEFVAARPGAELRNASLRMSGLRVEDEGNYTCLFVMFPQGSRSVDIWL

SEQ ID NO: 1695 - protein, 116 aa, synthetic construct
  REGION 1..116: note = CD155 v183 IgV
PGTGDVVVQAPTQVSGFLGDSVTLPCYLQVPNMEVTHVSQLTWARHGESGSMAVFRQTQGPSYSESKRLEFVGASPGAELRNASLRMFGLRVEDEGNYTCLFVTFPQGSRSVDIWL

SEQ ID NO: 1696 - protein, 116 aa, synthetic construct
  REGION 1..116: note = CD155 v184 IgV
PGTGDAVVQAPTQVSGFLGDSVTLPCYLQVPNTEVTHVSQLTWARHGESGSMAVFHQTQGPGYSESKRLEFVAARPGAELRNASLRMSGLRVEDEGNYTCTFVTFPQRIRSVDIWL

SEQ ID NO: 1697 - protein, 116 aa, synthetic construct
  REGION 1..116: note = CD155 v185 IgV
PGTGDVVVQAPTQVTGFLGDSVTLPCYLQVPNMEVTHVSQLTWARHGEAGSMAAFHRTKGPCYSESKRLEFVAARPGAELRNASLRMTGLRVEDEGYYTCLFVMFPQGSRSVDIWL

SEQ ID NO: 1698 - protein, 116 aa, synthetic construct
  REGION 1..116: note = CD155 v186 IgV
PGTGDVVAQAPTQVFGFLGDSVTLPCYLQVPDMEVTHVSQLTWERHGESGSMAVFHQTKGPSYSESKRLEFVAARPGAELRNASLRMSGLRVEDEDNYTCLFVMFPQGSRNVDIWL

SEQ ID NO: 1699 - protein, 116 aa, synthetic construct
  REGION 1..116: note = CD155 v187 IgV
PGTGDVVAQAPTQVTGFLGDSVTLPCYLQVPSMEVTHVSQLTWARHGESGSMAVFHQTQGPSYSESKRLEFVAARPGAELRNATLRMSGLRVEDEGNYTCLFVTFPQGSRSVDIWL

SEQ ID NO: 1700 - protein, 116 aa, synthetic construct
  REGION 1..116: note = CD155 v188 IgV
PGTGDDVMLAPTQVSGFLGDSVTLPCYLQVPNMVVTHVSQLTWARHGESGSIAVFHRTQGPSYSESQRLEFVAARPGAELRNASLRMSGLRVEDEGNYTCMFVMFPQGSRSVDIWL

SEQ ID NO: 1701 - protein, 116 aa, synthetic construct
  REGION 1..116: note = CD155 v189 IgV
PGTGDVVVQAPSQVSGFLGDSVTLPCHLLVPNMEVTHVSQLTWARHGESGSMAVFHQTRGPSYSESKRLEFVAARPGAELRNASLRMSGLRVEDEGNYTCLFVMFPQGSRSVDIWL

SEQ ID NO: 1702 - protein, 122 aa, synthetic construct
  REGION 1..122: note = CD155 v144 IgV
WPPPGTGDVVVQAPTQVTDFLGDSVTLPCYLQVPNTEVTHVSQLTWARHGESGNMAVFHQTQGPSYSESKRLEFVAARPGAEQRNASLRMSGLRVEDEGNYTCLFVMYPQGSRSVDIWLRVL

SEQ ID NO: 1703 - protein, 122 aa, synthetic construct
  REGION 1..122: note = CD155 v145 IgV
WPPPGTGDLVVQAPTQVLGFLGDSVTLPCYLQVPNMEVTHVSQLTWARHGESGSVAVFHQTQGPSYSELKRLEFVAARPGEELRNASLRMSGLRVEDEGNYTCLFVMFPQGSRSVDIWLRVL

SEQ ID NO: 1704 - protein, 122 aa, synthetic construct
  REGION 1..122: note = CD155 v146 IgV
WPPPGTGDVVVQAPTQVFGFLGDSVTLPCYLQVPNMEVTQVSQLTWARHGESGSMAVFHQKKGPSYSESKRLEFVAARPGAELRNASLRMSGLRVEDEGNYTCMFVVFPQGSRSVDIWLRVL

SEQ ID NO: 1705 - protein, 122 aa, synthetic construct
  REGION 1..122: note = CD155 v147 IgV
WPPPGTGDVVVQAPTQVSGFLGDSVTLPCYLRVPNMEVTHVSQLTWARHGESGSMAVFHQTKGPSYSESKRLEFVAAGPGAELRNASLRMSGLRVEDEGNYTCLFVAFPQGSWSVDIWLRVL

SEQ ID NO: 1706 - protein, 122 aa, synthetic construct
  REGION 1..122: note = CD155 v148 IgV
WPPPGTGDVVVHAPTQVTGFSSDSVTLPCYLQVPNMEVTHVSQLTWARHGESGSMAAFHQTRGPSYSESKRLEFVAARPGAELRNASLRMSGLRVEDEGNYTCLFVMFPQGSRSVDIWLRVL

SEQ ID NO: 1707 - protein, 122 aa, synthetic construct
  REGION 1..122: note = CD155 v149 IgV
WPPPGTGDIVVQAPTQVSGFLGDPVTLPCYLQVPNMEVTHVSQLTWARQGESGSMAVYHRTKGPSYSESKRLEFVAARPGAELRNASLRMSGLRVEDEGNYTCLFVMFPQGSRSVDIWLRVL

SEQ ID NO: 1708 - protein, 122 aa, synthetic construct
  REGION 1..122: note = CD155 v150 IgV
WPPPGTGDVVVQAPTQVTGFLGDSVTLPCYLQVPNMEVTHVSQLTCARRGESGSMAVFHQTQGPAYVESKRLEFVTARPGAELRNATLRMFGLRVEDEGNYTCMFVTFPQGSRSVDIWLRVL

SEQ ID NO: 1709 - protein, 122 aa, synthetic construct
  REGION 1..122: note = CD155 v151 IgV
WPPPGTGDVVVQAPTQVSGFLGDSVTLPCYLQVPNMEVTHVTQLTWARHGGSGSMAVFHQTQGPSYSESKRLEFVAARPGAELRNASLRMSWLRVEDEGNYTCLFVMFPQGSRSVDIWLRVL

SEQ ID NO: 1710 - protein, 122 aa, synthetic construct
  REGION 1..122: note = CD155 v152 IgV
WPPPGTGDVFVQAPSQVLGFLGDSVTLPCYLQVPNMEVTHVSQLTWAQHGESGSMAVFHQTQGPSYSESKRLEFVAARPGAELRNASLRMSGLRVEDEGNYTCLFVMFPQGSRSMDIWLRVL

SEQ ID NO: 1711 - protein, 122 aa, synthetic construct
  REGION 1..122: note = CD155 v153 IgV
WPPPGTGDVVVQAPTQVSGFMGDSVTLPCFLQVPDMEVTHVSQLTWARHGESGSMAVFHQTQGPSYSESKRLEFVAARLGAELWNASLRMSGLRVEDEGNYTCLFVMFPQGSRSVGIWLRVL

SEQ ID NO: 1712 - protein, 122 aa, synthetic construct
  REGION 1..122: note = CD155 v154 IgV
WPPPGTGDVVVQAPTQVFGFLGDSVTLPCYLQVPNMEVTHVSQLTWARHGVSGGMAVFHRTQGPSYSESKRLEFVAARQGAGLRNATLRISRLRVEDEGNYTCLFVMFPQGSRSVDIWLRVL

SEQ ID NO: 1713 - protein, 122 aa, synthetic construct
  REGION 1..122: note = CD155 v155 IgV
WPPPGTGDVVVQAPTHVFGFLGDSVTLPCYLQVPNMEVTHVSQLTWARHGESGSMAVFHQTQGPSYSESKRLEFVAARLGAELRNASLRMSGLRVEDEGNYTCLFVMFPQGSRSVDIWLRVL

SEQ ID NO: 1714 - protein, 122 aa, synthetic construct
  REGION 1..122: note = CD155 v156 IgV
WPPPGTGDVVVQAPTQVTGFLGGSVTLPCYLQVPNMEVTHVSQLTWARHGESGSMAVFHRTQGPSYLESKRLEFVAARPGAELRNASLRMSGLRVEDEGNYTCLFVMFPQGSRSADIWLRVL

SEQ ID NO: 1715 - protein, 122 aa, synthetic construct
  REGION 1..122: note = CD155 v157 IgV
WPPPGTGGIVAQAPTQVTGFLGDSVMLPCYLQVPNMEVTHVSQLTWARHGEPGSMAVFHQTQGPSYSESKRLEFVAARPGAELRNASLRMSALRVEDEGNYTCLFVLFPQGSRSADIWLRVL

SEQ ID NO: 1716 - protein, 122 aa, synthetic construct
  REGION 1..122: note = CD155 v158 IgV
WPPPGTGDIVVQAPTQVFGFLGDSVTLPCYLQVPNMEVTHVSQLTWERHSESGSMAVFHQTQGPSYSGSKRLEFVAARPGAELRNASLRMSGLRVEDEGNYTCLFVMFPQGSRSVDIWLRVL

SEQ ID NO: 1717 - protein, 122 aa, synthetic construct
  REGION 1..122: note = CD155 v159 IgV
WPPPGTGDVVVQAPTQVSGFLGDSVTLPCYLQVPNMEVTHVSQLTWARHGESGSIAVFHQTKGPSYSEPKRLEFVAARPGAELRNASLRMSGLRVEDEGNYTCLFVMFPQGSRSVDIWLRVL

SEQ ID NO: 1718 - protein, 122 aa, synthetic construct
  REGION 1..122: note = CD155 v160 IgV
WPPPGTGDVVVQAPTQVTGFLGDSVTLPCYLQVPNMEVSHVSQLTWARHGEPGRMAVFHQTQGPSYSESKRLEFVAARPGAELRNASLRMSGLRVEDEGNYTCLFVMFPQGSRSVDIWLRVL

SEQ ID NO: 1719 - protein, 122 aa, synthetic construct
  REGION 1..122: note = CD155 v161 IgV
WPPPGTGDVVVQAPTQVSGFLGNSVTLPCYLQVPNMEVTHVSQLTWARHGESGSMAVFHQTQGPSYSESKRLEFVAARPGAELRNASLRMSGLRVEDEGNYTCLFVMFPQGSRNVDIWLRVL

SEQ ID NO: 1720 - protein, 122 aa, synthetic construct
  REGION 1..122: note = CD155 v162 IgV
WPPPGTGDVVVQAPTQVSGFLGDSVTLPCYLQVSNMEVTHVSQLTWARHGVSGSMAVFHQTQGPSYSESKRLEFVAARPGAELRNASLRMSGLRVEDEGNYTCLFVTFPQRSRSVDIWLRVL

SEQ ID NO: 1721 - protein, 122 aa, synthetic construct
  REGION 1..122: note = CD155 v163 IgV
WPPPGTGDVVVQAPTQVSGFLGDSVTLPCYLQVPNMEVTHVSQLTWARHGESGSMAVFNQTQGPSYSESKRLEFAAARPGTELRNASLRMSGLRVEDEGNYTCMFVMFPQGSRSVDIWLRVL

SEQ ID NO: 1722 - protein, 122 aa, synthetic construct
  REGION 1..122: note = CD155 v164 IgV
WPPPGTGDVVVQAPTQVSGFLGDSVTLPCYLQVPNMEVTHVSQLTRARHGESGSMAVFHQTQGPSYSDSKRLEFVAARPGAELRNASLRMSGLRVEDEGNYTCLFVMFPQGSGSVDIWLRVL

SEQ ID NO: 1723 - protein, 122 aa, synthetic construct
  REGION 1..122: note = CD155 v165 IgV
WPPPGTGDLVVQAPTQVFGFLGDSVTLPCYLQVPNMEVTHVSQLAWARHGESGSMAVFHQTQGPAYVESKRLEFVAAKVGAELRNASLRMSGLRVEDEGNYTCLFVMFPQGSRTVDIWLRVL

SEQ ID NO: 1724 - protein, 122 aa, synthetic construct
  REGION 1..122: note = CD155 v166 IgV
WPPPGTGDVVVQAPTQVTGFLGDSVTLPCYLQVPNMEVTHVSQLTWARHGESGSLAVFHQRQGPSYSESKRLEFVAARPGAELRNASLRMSGLRVEDEGNYTCLFIMFPQGSRSVDIWLRVL

SEQ ID NO: 1725 - protein, 122 aa, synthetic construct
  REGION 1..122: note = CD155 v167 IgV
WPPPGTGDVVVQAPIQVSGFLGDSVTLPCYLQMPFMEVSHVSQLTWARHGESGSLAVFHQTQGPSYSESKRLEFVAASPGAELRNASLRMSGLRVEDEGNYTCLFVMFPQGSRSVDIWLRVL

SEQ ID NO: 1726 - protein, 122 aa, synthetic construct
  REGION 1..122: note = CD155 v168 IgV
WPPPGTGDVVVQAPTQVSGFLGDSVTLPCYLQVPNMEVTHVSQLTWARHGESGSMAVFHQTKGPSYSESERLEFVAARPGAELRNASLRMSELRVEDEGNYTCLFVTFPQGSWSVDIWLRVL

SEQ ID NO: 1727 - protein, 122 aa, synthetic construct
  REGION 1..122: note = CD155 v169 IgV
WPPPGTGDVVVQAPTQVFGILGDSVMLPCYLQVPNMEVTHVSQLTWVRHGKSGSMAVFHQTQGPSYSESKRLEFVAARPGAELRNASLRMSGLRVEDEGNYTCLFVTFPQGSRSVDIWLRVL

SEQ ID NO: 1728 - protein, 122 aa, synthetic construct
  REGION 1..122: note = CD155 v170 IgV
WPPPGTGDVVVQAPTQVTGFLGASVTLPCYLQVPNMEVTHVSQLTWARHGESGSMAVFHHTQGPSYSESKRLEFVAARPGAELRNASLRVSGLRVEDEGNYTCLFVMFPQGSRSVDIWLRVL

SEQ ID NO: 1729 - protein, 122 aa, synthetic construct
  REGION 1..122: note = CD155 v171 IgV
WPPPGTGDVVVQAPTQVSGFLGGSVTLPRYLQVPDMGVTHVSQLTWARHGESGSIAVFHQTKGPAYGESKRLEFVAAGPGAELRNASLRMSGLRVEDEGNYTCMFVMFPRGSRSVDIWLRVL

SEQ ID NO: 1730 - protein, 122 aa, synthetic construct
  REGION 1..122: note = CD155 v172 IgV
WPPPGTGDVVVQEPTQVSGFLGDSVTLPCYLQVPNREVTHVSQLTWARHGESGSMAVFHQTKGPSYTESKRLEFVAARPGAELRDASLRMSGLRVEDEGNYTCLFVMFPQGSRSVDIWLRVL

SEQ ID NO: 1731 - protein, 122 aa, synthetic construct
  REGION 1..122: note = CD155 v173 IgV
WPPPGTGDIVVQAPTQVTGFLGDSVTLPCYLQVPNMEVTHVSQLTWARRGESGSMAVFHQTQGPSYSESKRLEFVAARPGAELRDASLRMSGLRVEDEGNYTCTFVMFPQGSRSVDIWLRVL

SEQ ID NO: 1732 - protein, 122 aa, synthetic construct
  REGION 1..122: note = CD155 v174 IgV
WPPPGTGDAVVQAPTQVFGFLGDSVTLPCYLQVPNMEVTHVSQLTWARHGESGSMAVFHQSLGPSYSESKRLEFVAARPGAELRNASLRMSGLRVEDEGNYTCLFVTFPQRSRSVDIWLRVL

SEQ ID NO: 1733 - protein, 122 aa, synthetic construct
  REGION 1..122: note = CD155 v175 IgV
WPPPGTGEVVVQAPTQVTGFLGDSVTLPCYLQVPNMEVTHVSQLTWARHGESGSMAVFHQAQGPSYSESKRLEFVAARPGAELRNASLRMSGLRVEDEGNYTCLFVMFPQGSRSVDIWLRVL

SEQ ID NO: 1734 - protein, 122 aa, synthetic construct
  REGION 1..122: note = CD155 v176 IgV
WPPPGTGDVVVQAPTQVSGFLGDSVTLPCYLQVPNMEVTHASQLTWARRGESGCMAVFHQTQGPSYSESKRLEFVAARSGAELRYASPRMSGLRVEDEGNYTCMFVMFPQGSRSVDIWLRVL

SEQ ID NO: 1735 - protein, 122 aa, synthetic construct
  REGION 1..122: note = CD155 v177 IgV
WPPPGTGDVVEQAPTQVHGYLGDSETLPCYLQVPSMEVTHVSQLTWARRGESGSMAVFHQTQGPSYSESKRLEFVAARPGAELRNASLRMSGLRVEDEGNYTCLFVMFPQRSRSVDIWLRVL

SEQ ID NO: 1736 - protein, 122 aa, synthetic construct
  REGION 1..122: note = CD155 v178 IgV
WPPPGTGDVVAQAPTQVFGFLGASVTLPCYLQVPNMEVTHVSQLTWARHGESGSMAVFHQTQGPSYSESKRLEFVAARPDAELRNASLRMFGLRAEDEGNYTCLFVMFPQGSRSVDIWLRVL

SEQ ID NO: 1737 - protein, 122 aa, synthetic construct
  REGION 1..122: note = CD155 v179 IgV
WPPPGTGDVVVQAPTQVSGFLGDSVTLPCYLQVPNMEVTHVSQLTWARHGESGSMAVFHQTQGPSYSESRRLEFVAARPGAELRNASLRMSGLRVEDEGNYTCLFVTFPQRSRSVDIWLRVL

SEQ ID NO: 1738 - protein, 122 aa, synthetic construct
  REGION 1..122: note = CD155 v180 IgV
WPPPGTGDLVMQAPTQVSGFLGDSVTLPCYLQVPSMEVTHVSQLTWARHGESGGMAVFHQTKGPSYSESKRLEFVAARPGAELRNASLRMFGLRVEDEGNYTCMFVMFPQGSRSMDIWLRVL

SEQ ID NO: 1739 - protein, 122 aa, synthetic construct
  REGION 1..122: note = CD155 v181 IgV
WPPPGTGDLVVQAPTQVYGFLGDSATLPCYLQVPNMEGTHVSQLTWARHGESGSVAVFHQTQGPSYSESKRLEFVATRPGAELRNASLRISGLRVEDEGNYTCMFVTFPQGSRSVDIWLRVL

SEQ ID NO: 1740 - protein, 122 aa, synthetic construct
  REGION 1..122: note = CD155 v182 IgV
WPPPGTGDVGVQAPTQVTGFLGDSVTLPCYLQVPNMEVTHVSQLTWARHGESGSMAVFHQTQGPSYSESKRQEFVAARPGAELRNASLRMSGLRVEDEGNYTCLFVMFPQGSRSVDIWLRVL

SEQ ID NO: 1741 - protein, 122 aa, synthetic construct
  REGION 1..122: note = CD155 v183 IgV
WPPPGTGDVVVQAPTQVSGFLGDSVTLPCYLQVPNMEVTHVSQLTWARHGESGSMAVFRQTQGPSYSESKRLEFVGASPGAELRNASLRMFGLRVEDEGNYTCLFVTFPQGSRSVDIWLRVL

SEQ ID NO: 1742 - protein, 122 aa, synthetic construct
  REGION 1..122: note = CD155 v184 IgV
WPPPGTGDAVVQAPTQVSGFLGDSVTLPCYLQVPNTEVTHVSQLTWARHGESGSMAVFHQTQGPGYSESKRLEFVAARPGAELRNASLRMSGLRVEDEGNYTCTFVTFPQRIRSVDIWLRVL

SEQ ID NO: 1743 - protein, 122 aa, synthetic construct
  REGION 1..122: note = CD155 v185 IgV
WPPPGTGDVVVQAPTQVTGFLGDSVTLPCYLQVPNMEVTHVSQLTWARHGEAGSMAAFHRTKGPCYSESKRLEFVAARPGAELRNASLRMTGLRVEDEGYYTCLFVMFPQGSRSVDIWLRVL

SEQ ID NO: 1744 - protein, 122 aa, synthetic construct
  REGION 1..122: note = CD155 v186 IgV
WPPPGTGDVVAQAPTQVFGFLGDSVTLPCYLQVPDMEVTHVSQLTWERHGESGSMAVFHQTKGPSYSESKRLEFVAARPGAELRNASLRMSGLRVEDEDNYTCLFVMFPQGSRNVDIWLRVL

SEQ ID NO: 1745 - protein, 122 aa, synthetic construct
  REGION 1..122: note = CD155 v187 IgV
WPPPGTGDVVAQAPTQVTGFLGDSVTLPCYLQVPSMEVTHVSQLTWARHGESGSMAVFHQTQGPSYSESKRLEFVAARPGAELRNATLRMSGLRVEDEGNYTCLFVTFPQGSRSVDIWLRVL

SEQ ID NO: 1746 - protein, 122 aa, synthetic construct
  REGION 1..122: note = CD155 v188 IgV
WPPPGTGDDVMLAPTQVSGFLGDSVTLPCYLQVPNMVVTHVSQLTWARHGESGSIAVFHRTQGPSYSESQRLEFVAARPGAELRNASLRMSGLRVEDEGNYTCMFVMFPQGSRSVDIWLRVL

SEQ ID NO: 1747 - protein, 122 aa, synthetic construct
  REGION 1..122: note = CD155 v189 IgV
WPPPGTGDVVVQAPSQVSGFLGDSVTLPCHLLVPNMEVTHVSQLTWARHGESGSMAVFHQTRGPSYSESKRLEFVAARPGAELRNASLRMSGLRVEDEGNYTCLFVMFPQGSRSVDIWLRVL

SEQ ID NO: 1748 - protein, 231 aa, synthetic construct
  REGION 1..231: note = Fc (C5S (C220S), R77C, (R292C),N82G (N297G), V87C (V302C),L232del (K447del))
EPKSSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 1749 - protein, 231 aa, synthetic construct
  REGION 1..231: note = Fc with C220S/L234A/L235E/G237A/K447del
EPKSSDKTHTCPPCPAPEAEGAPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 1750 - protein, 230 aa, synthetic construct
  REGION 1..230: note = Fc with C220S/E233P/L234V/L235A/G236del/S267K/K447del
EPKSSDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 1751 - protein, 7 aa, synthetic construct
  REGION 1..7: note = Linker
GSGGGGS

SEQ ID NO: 1752 - protein, 5 aa, synthetic construct
  REGION 1..5: note = 4GS Linker
GGGGS

SEQ ID NO: 1753 - protein, 221 aa, synthetic construct
  REGION 1..221: note = PD-L1 ECD v66
FTVTVPKDLYVVEYGSNMTLECKFPVEEQLDLAALIVYWEMEGKDIIQFVHGEEDLKAQHSSYRQRARLLKDQLSLGNAALQITDVKLRDAGVYRCMISYGGGADYKRITVKVNAPYNKINQRILVVDPVTSEHELTCQAEGYPKAEVIWTSSDHQVLSGKTTTTNSKREEKLFNVTSTLRINTTTNEIFYCTFRRLDPEENHTAELVIPELPLAHPPNER

SEQ ID NO: 1754 - protein, 108 aa, synthetic construct
  REGION 1..108: note = PD-L1 IgV 66
PKDLYVVEYGSNMTLECKFPVEEQLDLAALIVYWEMEGKDIIQFVHGEEDLKAQHSSYRQRARLLKDQLSLGNAALQITDVKLRDAGVYRCMISYGGGADYKRITVKV

SEQ ID NO: 1755 - protein, 115 aa, synthetic construct
  REGION 1..115: note = PD-L1 IgV v66
FTVTVPKDLYVVEYGSNMTLECKFPVEEQLDLAALIVYWEMEGKDIIQFVHGEEDLKAQHSSYRQRARLLKDQLSLGNAALQITDVKLRDAGVYRCMISYGGGADYKRITVKVNA

SEQ ID NO: 1756 - protein, 221 aa, Homo sapiens [sequence omitted]

SEQ ID NO: 1757 - protein, 221 aa, synthetic construct
  REGION 1..221: note = PD-L1 ECD v67
FTVTVPKDLYVVEYGSNMTIECKFPVEKQLDLAALIVYWEMEDKNIIQFVHGEEDLRVQHSSYRQRARLLKDQLSLGNAALQITDVKLQDAGVYRCMIGYGGADYKRITVKVNAPYNKINQRILVVDPVTSEHELTCQAEGYPKAEVIWTSSDHQVLSGKTTTTNSKREEKLFNVTSTLRINTTTNEIFYCTFRRLDPEENHTAELVIPELPLAHPPNERT

SEQ ID NO: 1758 - protein, 221 aa, synthetic construct
  REGION 1..221: note = PD-L1 ECD v68
FTVTVPKDLYVVEYGSNMTIECKFPVEKQLDLAALIVYWEMEDKNIIQFVHGEEDLRVQHSSYRQRARLLKDQLSLGNAALQITDVKLQDAGVYRCMIGYGGADYKRITVKVNAPYNKINQRILVVDPVTSEHELTCQAEGYPKAEVIWTSSDHQVLSGKTTTTNSKREEKLFNVTSTLRINTTTNEILYCTFRRLDPEENHTAELVIPELPLAHPPNERT

SEQ ID NO: 1759 - protein, 221 aa, synthetic construct
  REGION 1..221: note = PD-L1 ECD v69
FTVTVPKDLYVVEYGSNVTIECKFPVEKQLDLAALIVYWEMEDKNIIQFVHGEEDLKVQHSSYRQRARLLKDQLSLGNAALQITDVKLQDAGVYRCLISYGGADYKRITVKVNAPYNKINQRILVVDPVTSEHELTCQAEGYPKAEVIWTSSDHQVLSGKTTTTNSKREEKLFNVTSTLRINTTTNEIFYCTSRGLDPEKNQTAELVIPELPLAHPPNERT

SEQ ID NO: 1760 - protein, 221 aa, synthetic construct
  REGION 1..221: note = PD-L1 ECD v70
FTVTVPKDLYVVEYGSNMTIECKFPVEKQLDLAALSVYWEKEDKNIIQFVHGEEDLKVQHSSYRQRARLLKDQLSLGNAALQITDVKLQDAGVYRCLISYGGADYKRITVKVNAPYNKINQRILVVDPVTSEHELTCQAEGYPQAEVIWTSSDHQVLSGKTTTTNSKREEKLFNVTSTLRINTTTNEIFYCTFRGLDPEKNQTAEFVIPELPLAHPPNERT

SEQ ID NO: 1761 - protein, 221 aa, synthetic construct
  REGION 1..221: note = PD-L1 ECD v71
FTVTVPKDLYVVEYGSNMTIERKFPVEKQLDLAALIVYWEMEDKNIIQFVHGEEDLKVQHSSYRLRARLLKDQLSLGNAALQITDVKLQDAGVYRCMISYGGADYKRITVKVNAPYNKINQRISVVDPVTSEHELTCQAEGYPQAEVIWTSSDHQVLSGKTTTTNSKREEKLFNVTSTLRINTTTNEIFYCTFRGLDPENNQTAELVIPELPLAHPPNERL

SEQ ID NO: 1762 - protein, 221 aa, synthetic construct
  REGION 1..221: note = PD-L1 ECD v72
FTVTVPKDLYVVEYGSNVTIECKFPVEKQLDLAALIVYWEMEDKNIIQFVHGEEDLKVQHSSYRQRARLLKDQLSLGNAALQITDVKLQDAGVYRCMLSYGGADYKRITVKVNAPYNKINQRISVVDPVTSEHELTCQAEGYPKAEVIWTSSDHQVLSGKTTTTNSKREEKLFNVTSTLRINTTTNEIFYCTFRRLDTEENHTAEFVIPELPLAHPPNERT

SEQ ID NO: 1763 - protein, 221 aa, synthetic construct
  REGION 1..221: note = PD-L1 ECD v73
FTVTVPKDLYVVEYGSNMTIECKFPVEKQLDLAALIVYWEMEDKNIIQFVHGEEDLKVQHSSYRQRARLLKDQLSLGNAALQITDVKLQDAGVYRCMIGYGGADYKRITVKVNAPYSKINQRILVVDPVTSEHELTCQAEGYPKAEVVWTSSDHQVLSGKTTTTNSKREERLFNVTSTLSINTTTNEIFYCTFRRLDPEENHTAELVIPELPLAHPPNERT

SEQ ID NO: 1764 - protein, 221 aa, synthetic construct
  REGION 1..221: note = PD-L1 ECD v74
FTVTVPKDLYVVEYGSNMTIECKFPVEKQLDLAALTVYWEMEDKNIIQFVHGEEDLKVQHSSYRQRARLLKDQLSLGNAALQITDVKLQDAGVYRCLISYGGVDYKRITVKVNAPYNKINQRILVVDPVTSEHELTCQAEGYPKAEVIWTSSDHHVLSGKTTTTNSKREEKLFNVTSTLRINTTTNEIFYCTFRRLDPEENHTAELVIPELPLAHPPNERT

SEQ ID NO: 1765 - protein, 221 aa, synthetic construct
  REGION 1..221: note = PD-L1 ECD v75
FTVTVPKDLYVVEYGSNMTIECKFPVEIQLDLAALIVYWEMEDKNIIQFVHGEEDLKVQHSSYRQRARLLKDQLSLGNAALQITDVKLQDAGVYRCMIGYGGADYKRITVKVNAPYNKINQRILVVDPVTSEHELTCQAEGYPKAEVIWTSSDHQVLSGKTTTTNSKREEKLFNVTSTLRINTTTNEIFYCTFRRLDPEENHTAELVIPELPLAHPPNERT

SEQ ID NO: 1766 - protein, 221 aa, synthetic construct
  REGION 1..221: note = PD-L1 ECD v76
FTVTVPKDLYVVEYGSNMTIECKFPVEKQLDLAALIVYWEMEDKNIIQFVHGEEDLKVQHSSYRQRARLLKDQLSLGNAALQITDVKLQDAGVYRCMISYGGADYKRITVKVNAPYNKINQRILVVDPVTSEHELTCQAEGYPKAEVIWTSSDHQVLSGKTTTTNSKREEKLFNVTSTLRINTTTNEIFYCTFRSLDPEENHTAELVIPELPLAHPPNERT

SEQ ID NO: 1767 - protein, 221 aa, synthetic construct
  REGION 1..221: note = PD-L1 ECD v77
FTVTVPKDLYVVEYGSNMTIECKFPVEKQLDLAALIVYWEMEDKNIIQFVHGEEDLKVQHSSYRQRARLLKDQLSLGNTALQITDVKLQDAGVYRCMIGYGGADYKRITVKVNAPYNKINQRILVVDPVTSEHELTCQAEGYPKAEVIWTSSDHQVLSGKTTTTNSKREEKLFNVTSTLRINTTANEIFYCTFRGLDPEKNQTAEFVIPELPLAHPPNERT

SEQ ID NO: 1768 - protein, 221 aa, synthetic construct
  REGION 1..221: note = PD-L1 ECD v78
FTVTVPKDLYVVEYGSNMTIECKFPVEKQLDLAALIVYWEMEDKNIIQFVHGEEDLRVQHSSYRQRARLLKDQLSLGNAALQITDVKLQDAGVYRCMIGYGGADYKRITVKVNAPYNKINQRISVVDPVTSEHELTCQAEGYPQAEVIWTSSDHQVLSGKTTTTNSKREEKLFNVTSTLRINTTTNEIFYCTFRRLDPEENHTAELVIPELPLAHPPNERT

SEQ ID NO: 1769 - protein, 221 aa, synthetic construct
  REGION 1..221: note = PD-L1 ECD v79
FTVTVPKDLYVVEYGSNMTIECKFPVEKQLDLAALIVYWEMEDKNIIQFVHGEEDLRVQHSSYRQRARLLKDQLSLGNAALQITDVKLQDAGVYRCMIGYGGADYKRITVKVNAPYNKINQRILVVDPVTSEHELTCQAEGYPKAEVIWTSSDHQVLSGKTTTTNSKREEKLFNVTSTLRINTTTNEIFYCTFRGLDPEENHTAELVIPELPLAHPPNERT

SEQ ID NO: 1770 - protein, 221 aa, synthetic construct
  REGION 1..221: note = PD-L1 ECD v80
FTVTVPKDLYVVEYGSNMTIECKFPVEKQLDLAALIVYWEMEDKNIIQFVHGEEVLKVQHSSYRQRARLLKDQLSLGNAALQITDVKLQDAGVYRCLIGYGGADYKRITVKVNAPYNKINQRILVVDPVTSEHELTCQAEGYPKAEVIWTSSDHQVLSGKTTTTNSKREEKLFNVTSTLRINTTTNEIFYCTFRRLDPEENHTAELVIPELPLAHPPNERT

SEQ ID NO: 1771 - protein, 221 aa, synthetic construct
  REGION 1..221: note = PD-L1 ECD v81
FTVTVPKDLYVVEYGSNMTIECKFPVGKQLDLAALTVYWEMEDKNIIQFVHGEENLKVQHSSYRQRARLLKDQLSLGNAALQITDVKLQDAGVYRCLISYGGADYKRITVEVNAPYNKINQRILVVDPVTSEHELTCQAEGYPKAEVIWTSSDHQVLSGKTTTTNSKREEKLFNVTSTLRINTTTNEIFYCTFRRLDPEENHTAELVIPELPLAHPPNERT

SEQ ID NO: 1772 - protein, 221 aa, synthetic construct
  REGION 1..221: note = PD-L1 ECD v82
FTVTVPKDLYVVEYGSNMTIECKFPVEKQLDLAALIVYWEMEDKNIIQFVHGEGDLKVQHSSYRQRARLLKDQLSLGNAALQITDVKLQDAGVYRCLIGYGGADYKRITVKVNAPYNKINQRILVVDPVTSEHELTCQAEGYPKAEVIWTSSDHQVLSGKTTTTNSKREEKLFNVTSTLRINTTTNEIFYCTFRRLDPEENHTAELVIPELPLAHPPNERT

SEQ ID NO: 1773 - protein, 221 aa, synthetic construct
  REGION 1..221: note = PD-L1 ECD v83
FTVTVPKDLYVVEYASNMTIECKFPVEKQLDLAALTVYWEMEDKNIIQFVHGEEDLKVQHSSYRQRARLLKDQLSLGNAALQITDVKLQDAGVYRCLISYGGADYKRITVEVNAPYNKINQRILVVDPVTSEHELTCQAEGYPKAEVIWTSSDHQVLSGKTTTTNSKREEKLFNVTSTLRINTTTNEIFYCTFRRLDPEENQTAELVIPELPLAHPPNERT

SEQ ID NO: 1774 - protein, 221 aa, synthetic construct
  REGION 1..221: note = PD-L1 ECD v84
FTVTVPKDLYVVEYASNMTIECKFPVEKQLDLAALTVYWEMEDKNIIQFVHGEEDLKVQHSSYRQRARLLKDQLSLGNAALQITDVKLQDAGVYRCMISYGGADYKRITVKVNAPYNKINQRILVVDPDTSEHELTCQAEGYPKAEVIWTSSDHQVLSGKTTTTNSKREEKLFNVTSTLRINTTTNEIFYCTFRRLDPEENHTAELVIPELPLAHPPNERT

SEQ ID NO: 1775 - protein, 221 aa, synthetic construct
  REGION 1..221: note = PD-L1 ECD v85
FTVTVPKDLYVVEYASNMTIECKFPVEKQLDLAALTVYWEMEDKNIIQFVHGEEDLKVQHSSYRQRARLLKDQLSLGNAALQITDVKLQDAGVYRCMISYGGADYKRITVKVNAPYNKINQRILVVDPDTSEHELTCQAEGYPKAEVIWTSSDHQVLSGKTTTTNSKREEKLFNVTSTLRINTTTNEIFYCTFRGLDPEENHTAELVIPELPLAHPPNERT

SEQ ID NO: 1776 - protein, 221 aa, synthetic construct
  REGION 1..221: note = PD-L1 ECD v86
FTVTVPKDLYVVEYASNMTIECKFPVEKQLDLAALIVYWEMEDKNIIQFVHGEEDLKVQHSSYRQRARLLKDQLSLGNAALQITDVKLQDAGVYRCMISYGGADYKRITVKVNAPYNKINQRILVVDPDTSEHELTCQAEGYPKAEVIWTSSDHQVLSGKTTTTNSKREEKLFNVTSTLRINTTTNEIFYCTFRRLDPEENHTAELVIPELPLAHPPNERT

SEQ ID NO: 1777 - protein, 221 aa, synthetic construct
  REGION 1..221: note = PD-L1 ECD v87
FTVTVPKDLYVVEYGSNMTIECKFPVEKQLDLAALSVYWEMEDKNIIQFVHGEEDLKVQHSSYRQRARLLKDQLSLGNAALQITDVKLQDAGVYRCLISYGGADYKRITVKVNAPYNKINQRILVVDPVTSEHELTCQAEGYPKAEVIWTSSDHQVLSGKTTTTNSKREEKLFNVTSTLRINTTTNEIFYCTFRRLDPEENHTAELVIPELPLAHPPNERT

SEQ ID NO: 1778 - protein, 221 aa, synthetic construct
  REGION 1..221: note = PD-L1 ECD v88
FTVTVPKDLYVVEYGSNMTIECKFPVEKQLDLAALTVYWEMEDKNIIQFVHGEENLKVQHSSYRQRARLLKDQLSLGNAALQITDVKLQDAGVYRCLISYGGADYKRITVEVNAPYNKINQRILVVDPVTSEHELTCQAEGYPKAEVIWTSSDHQVLSGKTTTTNSKREEKLFNVTSTLRINTTTNEIFYCTFRRLDPEENHTTELVIPELPLAHPPNERT

SEQ ID NO: 1779 - protein, 221 aa, synthetic construct
  REGION 1..221: note = PD-L1 ECD v89
FTVTVPKDLYVVEYGSNMTIECKFPVEKQLDLAALTVYWEMEDKNIIQFVHGEENLKVQHSSYRQRARLLKDQLSLGNAALQITDVKLQDAGVYRCLISYGGADYKRITVEVNAPYNKINQRILVVDPATSEHELTCQAEGYPKAEVIWTSSDHQVLSGKTTTTNSKREEKLLNVTSTLRINTTTNEIFYCTFRRLDPEENHTAELVIPELPLAHPPNERT

SEQ ID NO: 1780 - protein, 221 aa, synthetic construct
  REGION 1..221: note = PD-L1 ECD v90
FTVTVPKDLYVVEYGSNMTIECKFPVEKQLDLAALTVYWEMEDKNIIQFVHGEESLKVQHSSYRQRARLLKDQLSLGNAALQITDVKLQDAGVYRCLISYGGADYKRITVEVNAPYNKINQRILVVDPVTSEHELTCQAEGYPKAEVVWTSSDHQVLSGKTTTTNSKREEKLFNVTSTLSINTTTNEIFYCTFRRLDPEENHTAELVIPELPLAHPPNERT

SEQ ID NO: 1781 - protein, 221 aa, synthetic construct
  REGION 1..221: note = PD-L1 ECD v91
FTVTVPKDLYVVEYGSNMTIECKFPVEKQLDLAALTVYWEMEDKNIIQFVHREEDLKVQHSSYRQRARLLKDQLSLGNAALQITDVKLQDAGVYRCLISYGGADYKRITVKANAPYNKINQRILVVDPVTSEHELTCQAEGYPEAEVIWTSSDHQVLSGKTTTTNSKREEKLFNATSTLRINTTTNEIFYCTFRRLDTEENHTAELVIPELPLAHPPNERT

SEQ ID NO: 1782 - protein, 221 aa, synthetic construct
  REGION 1..221: note = PD-L1 ECD v92
FTVTVPKDLYVVEYGSNMTIECKFPVEKQLDLAALTVYWEMEDKNVIQFVHGEEGLKVQHSSYRQRARLLKDQLSLGNAALQITDVKLQDAGVYRCLISYGGADYERITVKVNAPYNKINQRILVVDPVTSEHELTCQAEGYPEAEVIWTSSDHQVLSGKTTTTNSKREEKLFNVTSTLRINTTANEIFYCTFRGLDPEENHTAELVIPELPLAHPPNERT

SEQ ID NO: 1783 - protein, 221 aa, synthetic construct
  REGION 1..221: note = PD-L1 ECD v93
FTVTVPKDLYVVEYGSNMTIECKFPVEKQLDLAALTVYWEMEDKNIIQFVHGEEDLKVQHSSYRQRARLLKDQLSLGNAALQTTDVKLQDAGVYRCLISYGGADYKRITVKVNAPYNKINQRILVVDPVTSEHELTCQAEGYPEAEVIWTSSDHQVLSGKTTTTNSKREEKLFNVTSTLRINTTTNEIFYCTFRRLDTEENHTAELVIPELPLAHPPNERT

SEQ ID NO: 1784 - protein, 221 aa, synthetic construct
  REGION 1..221: note = PD-L1 ECD v94
FTVTVPKDLYVVEYGSNMTIECKFPVEKQLDLAALTVYWEMEDKNIIQFVHGEEDLKVQHSSYRQRARLLKDQLSLGNAALQITDVKLQDAGVYRCLISYGGADYKRITVEVNAPYNKINQRILVVDPVTSEHELTCQAEGYPKAEVIWTSSDHQVLSGKTTTTNSKREEKLFNVTSTLRINTTTNEIFYCTFRRLDPEENHTAELVIPELPLAHPPNERT

SEQ ID NO: 1785 - protein, 221 aa, synthetic construct
  REGION 1..221: note = PD-L1 ECD v95
FTVTVPKDLYVVEYGSNMTIECKFPVEKQLDLAALTVYWEMEDKNIIQFVHGEEDLKVQHSSYRQRARLLKDQLSLGNAALQITDVKLQDAGVYRCLISYGGADYKRITVKVNAPYNKINQRILVVDPVTSEHELTCQAEGYPEAEVIWTSSDHQVLSGKTTTTNSKREEKLFNVTSTLRINTTTNEIFYCTFRRLDTEENHTAELVIPELPLAHPPNERT

SEQ ID NO: 1786 - protein, 221 aa, synthetic construct
  REGION 1..221: note = PD-L1 ECD v96
FTVTVPKDLYVVEYGSNMTIECKFPVEKQLDLAALTVYWEMEDKNIIQFVHGEEDLKVQHSSYRQRARLLKDQLSLGNAALQITDVKLQDAGVYRCLISYGGADYKRITVKVNAPYNKINQRILVVDPVTSEHELTCQAEGYPKAEVIWTSSDHHVLSGKTTTTNSKREEKLFNVTSTLRINTTTNEIFYCTSRRLDPEEYHTAELVIPELPLAHPPNERT

SEQ ID NO: 1787 - protein, 221 aa, synthetic construct
  REGION 1..221: note = PD-L1 ECD v97
FTVTVPKDLYVVEYGSNMTIECKFPVEKQLDLAALTVYWEMEDKNIIQFVHGEEDLKVQHSSYRQRARLLKDQLSLGNAALQITDVKLQDAGVYRCLISYGGADYKRITVKVNAPYNKINQRILVVDPDTSEHELTCQAEGYPKAEVIWTSSDHQVLSGKTTTTNSKREEKLFNVTSTLRINTTTNEIFYCTFRRLDPEENHTAELVIPELPLAHPPNERT

SEQ ID NO: 1788 - protein, 221 aa, synthetic construct
  REGION 1..221: note = PD-L1 ECD v98
FTVTVPKDLYVVEYGSNMTIECKFPVEKQLDLAAPSVYWEMEDKNIIQFVHGEEDLKVQHSSYRQRARLLKDQLSLGNAALQITDVKLQDAGVYRCLISYGGADYKRITVEVNAPYNKINQRILVVDPVTSEHELTCQAEGYPKAEVIWTSSDHQVLSGKTTTTNSKREEKLFNVTSTLRINTTTNEIFYCTFRRLDPEENHTAELVIPELPLAHPPNERT

SEQ ID NO: 1789 - protein, 221 aa, synthetic construct
  REGION 1..221: note = PD-L1 ECD v99
FTVTVPKDLYVVEYGSNITIECKFPVEKQLDLAALTVYWEMEDKNIIQFVHGGEDLKVQHSSYRQRARLLKDQLSLGNAALQITDVKLQDAGVYRCLISYGGADYKRITVKVNAPYNKINQRILVVDPVTSEHELTCQAEGYPEAEVIWTSSDHQVLSGKTTTTNSKREEKLFNVTSTLRINTTTNEIFYCTFRRLDPGENHTAELAIPELPLAHPPNERT

SEQ ID NO: 1790 - protein, 221 aa, synthetic construct
  REGION 1..221: note = PD-L1 ECD v100
FTVTVPKDLYVVEYGSNTTIECKFPVEKQLDLAALTVYWEMEDKNIIQFVHGEENLKVQHSSYRQRARLLKDQLSLGNAALQITDVKLQDAGVYRCLISYGGADYKRITVEVNAPYNKINQRILVVDPVTSEHELTCQAEGYPKAEVIWTSSDHQVLSGKTTTTNSKREEKLFNVTSTLRINTTTNEIFYCTFRRLDPEENHTAELVIPELPLAHPPNERT

SEQ ID NO: 1791 - protein, 221 aa, synthetic construct
  REGION 1..221: note = PD-L1 ECD v101
FTVTVPKDLYVVEYGSNVTIECKFPVEKQLDLAALIVYWEMEDKNIIQFVHGEEDLKVQHSSYRQRARLLKDQLSLGNAALQITDVKLQDAGVYRCLISYGGADYKRITVKVNAPYNKINQRILVVDPVTSEHELTCQAEGYPKAEVIWTSSDHQVLSGKTTTTNSKREEKLFNVNSTLRINTTTNEIFYCTFRGLDPEENHTAELVIPELPLAHPPNERT

SEQ ID NO: 1792 - protein, 221 aa, synthetic construct
  REGION 1..221: note = PD-L1 ECD v102
FTVTVPKDLYVVEYGSNMTIECKFPVEKQLDLAALIVYWEMEDKNIIQFVHGEEDLKVQHSSYRQRARLLKDQLSLGNAALQITDVKLQDAGVYRCLIGYGGADYKRITVKVNAPYNKINQRILVVDPVTSEHELTCQAEGYPKAEVIWTSSDHQVLSGKTTTTNSKREEKLFNVTSTLRINTTTNEIFYCTFRRLDPEENHTAELVIPELPLAHPPNERT

SEQ ID NO: 1793 - protein, 221 aa, synthetic construct
  REGION 1..221: note = PD-L1 ECD v103
FTVTVPKDLYVVEYGSDMTIECKFPVEKQLDLAALIVYWEMEDKNIIQFVHGEEDLKVQHSSYRQRARLLKDQLSLGNAALQITDVKLQDAGVYRCLIGYGGADYKRITVKVNAPYNKINQRILVVDPVTSEHELTCQAEGYPKAEVIWTSSDHQVLSGKTTTTNSKREEKLFNVTSTLRINTTTNEIFYCTFRRLDPEENHTAELVIPELPLAHPPNERT

SEQ ID NO: 1794 - protein, 221 aa, synthetic construct
  REGION 1..221: note = PD-L1 ECD v104
FTVTVPKDLYVVEYGSNMTIECKFPVEKQLDLAALIVYWEMEDKNIIQFVHGEEDLKVQHSSYRQRARLLKDQLSLGNAALQITDVKLQDAGVYRCMIGYGGADYKRITVKVNAPYNKINQRILVVDPVTSEHELTCQAEGYPKAEVIWTSSDHQVLSGKTTTTNSKREEKLFNVTSTLRINTTANEIFYCTFRGLDTEENHTAELVIPELPLAHPPNERT

SEQ ID NO: 1795 - protein, 221 aa, synthetic construct
  REGION 1..221: note = PD-L1 ECD v105
FTVTVPKDLYVVEYGSNMTIECKFPVEKQLDLAALIVYWEMEDKNIIQFVHGEEDLKVQHSSYRQRARLLKDQLSLGNAALQITDVKLQDAGVYRCMISYGGADYKRITVKVNAPYNKINQRILVVDPDTSEHELTCQAEGYPKAEVIWTSSDHQVLSGKTTTTNSKREEKLFNVTSTLRINTTTNEIFYCTFRRLDPEENQTAELVIPELPLAHPPNERT

SEQ ID NO: 1796 - protein, 221 aa, synthetic construct
  REGION 1..221: note = PD-L1 ECD v106
FTVTVPKDLYVVEYGSNMTIECKFPVEKQLDLAALIVYWEMEDKNIIQFVHGEEDLKVQHSSYRQRARLLKDQLSLGNAALQITDVKLQDAGVYRCMISYGGADYKRITVKVNAPYNKINQRILVVDPDTSEHELTCQAEGYPKAEVIWTSSDHQVLSGKTTTTNSKREEKLFNVTSTLRINTTTNEIFYCTFRRLDTEENHTAELVIPELPLAHPPNERT

SEQ ID NO: 1797 - protein, 221 aa, synthetic construct
  REGION 1..221: note = PD-L1 ECD v107
FTVTVPKDLYVVEYGSNMTIECKFPVEKQLDLAALIVYWEMEDKNIIQFVHGEEDLKVQHSSYRQRARLLKDQLSLGNAALQITDVKLQDAGVYRCMISYGGADYKRITVKVNAPYNKINQRILVVDPDTSEHELTCQAEGYPKAEVIWASSDHQVLSGKTTTTNSKREEKLFNVTSTLRINTTTNEIFYCTFRRLDPEENHTAELVIPELPLAHPPNERT

SEQ ID NO: 1798 - protein, 221 aa, synthetic construct
  REGION 1..221: note = PD-L1 ECD v108
FTVTVPKDLYVVEYGSNMTIECKFPVEKQLDLAALIVYWEMEDKNIIQFVHGEEDLKVQHSSYRQRARLLKDQLSLGNAALQITDVKLQDAGEYRCMISYGGADYKRITVKVNAPYNKINQRILVVDPDTSEHELTCQAEGYPKAEVIWTSSDHQVLSGKTTTTNSKREEKLFNVTSTLRINTTTNEIFYCTFRRLDPEENHTAELVIPELPLAHPPNERT

SEQ ID NO: 1799 - protein, 221 aa, synthetic construct
  REGION 1..221: note = PD-L1 ECD v109
FTVTVPKDLFVVEYGSNVTIECKFPVEKQLDLAALIVYWEMEDKNIIQFVHGEEDLKVQHSSYRQRARLLKDQLSLGNAALQITDVKLQDAGVYRCMIGYGGADYKRITVKVNAPYNKINQRILVVDPVTSEHELTCRAEGYPKAEVIWTSSDHQVLSGKTTTTNSKREEKLFNVTSTLRINTTTNEIFYCTFRRLDPEENHAAELVIPELPLAHPPNERT

SEQ ID NO: 1800 - protein, 221 aa, synthetic construct
  REGION 1..221: note = PD-L1 ECD v110
FTVTVPKDLYVVEYGSNMTIECKFPVEKQLDLAALIVYWEMEDKDIIQFVHGEEDLKVQHSSYRQRARLLKDQLSLGNAALQITDVKLQDAGVYRCMISYGGADYKRITVKVNAPYNKINQRILVVDPVTSEHELTCQAEGYPKAEVIWTSSDHQVLSGKTTTTNSKREEKLFNVTSTLRINTTTNEIFYCTFRRLDPEENHTAELVIPELPLAHPPNERT

SEQ ID NO: 1801 - protein, 221 aa, synthetic construct
  REGION 1..221: note = PD-L1 ECD v111
FTVTVPKDLYVVEYGSNMTIECKFPVEKQLDLAALIVYWEMEDKNIIQFVHGEEDLKVQHSSYRQRARLLKDQLSLGNAALQITDVKLQDAGVYRCMISYGGADYKRITVKVNAPYNKINQRILVVDPVTSEHELTCQAEGYPKAEVIWTSSDHQVLSGMTTTTNSKREEKLFNVTSTLRINTTTNEIFYCTFRGLDPEENHTAELVIPELPLAHPPNERT

SEQ ID NO: 1802 - protein, 221 aa, synthetic construct
  REGION 1..221: note = PD-L1 ECD v112
FTVTVPKDLYVVEYGSNMTIECKFPVEKQLDLAALIVYWEMEDKDIIQFVHGEEDLKVQHSSYRQRARLLKDQLSLGNAALQITDVKLQDAGVYRCMISYGGADYKRITVKVNAPYNKINQRILVVDPVTSEHELTCQAEGYPEAEVIWTSSDHQVLSGKTTTTNSKREEKLFNVTSTLRINTTTNEIFYCTFRRLDPEENHTAELVIPELPLAHPPNERT

SEQ ID NO: 1803 - protein, 221 aa, synthetic construct
  REGION 1..221: note = PD-L1 ECD v113
FTVTVPKDLYVVEYGSNMTIECKFPVEKQLDLAALIVYWEMEDKDIIQFVHGEEDLKVQHSSYRQRARLLKDQLSLGNAALQITDVKLQDAGVYRCMISYGGADYKRITVKVNAPYNKINQRILVVDPVTSEHELTCQAEGYPKAEVIWTSSDHQVLSGKTTTTNSKREEKLFNVTSTLRINTTTNEIFYCTFRRLDSEENHTAELVIPELPLAHPPNERT

SEQ ID NO: 1804 - protein, 221 aa, synthetic construct
  REGION 1..221: note = PD-L1 ECD v114
FTVTVPKDLYVVEYGSNMTIECKFPVEKQLDLAALIVYWEMEDKDIIQFVHGEEDLKVQHSSYRQRARLLKDQLSLGNAALQITDVKLQDAGVYRCMISYGGADYKRITVKVNAPYNKINQRILVVDPVTSEHELTCQAEGYPKAEVIWTSSDHQVLSGKTTTTNSKREEKLFNVTSTLRINTTTNEIFYCTFRRLDTEENHTAELVIPELPLAHPPNERT

SEQ ID NO: 1805 - protein, 221 aa, synthetic construct
  REGION 1..221: note = PD-L1 ECD v115
FTVTVPKDLYVVEYGSNMTIECKFPVEKQLDLAALIVYWEMEDKDIIQFVHGEEDLKVQHSSYRQRARLLKDQLSLGNAALQITDVKLQDAGVYRCMISYGGADYKRITVKVNAPYNKINQRILVVDPVTSEHELTCQAEGYPKAEVIWTSSDHQVLSGKTTTTNSKREEKLFNVTSTLRINTTTNEIFYCTFRGLDPEENHTAELVIPELPLAHPPNERT

SEQ ID NO: 1806 - protein, 221 aa, synthetic construct
  REGION 1..221: note = PD-L1 ECD v116
FTVTVPKDLYVVEYGSNMTIECKFPVEKQLDLAALIVYWEMEDKDIIQFVHGEEDLKVQHSSYRQRARLLKDQLSLGNAALQITDVKLQDAGVYRCMISYGGADYKRITVKVNAPYNKINQRILVVDPVTSEHELTCQAEGYPKAEVIWTSSDHQVLSGKTTTTNSKREEKLFNVTSTLRINTTTNEIFYCTFRSLDPEENHTAELVIPELPLAHPPNERT

SEQ ID NO: 1807 - protein, 221 aa, synthetic construct
  REGION 1..221: note = PD-L1 ECD v117
FTVTVPKDLYVVEYGSNMTIECKFPVEKQLDLAALIVYWEMEDKDIIQFVHGEEDLKVQHSSYRQRARLLKDQLSLGNAALQITDVKLQDAGVYRCMISYGGADYKRITVKVNAPYNKINQRILVVDPVTFEHELTCQAEGYPKAEVIWTSSDHQVLSGKTTTTNSKREEKLFNVTSTLRINTTTNEIFYCTFRRLDPEENHTAELVIPELPLAHPPNERT

SEQ ID NO: 1808 - protein, 221 aa, synthetic construct
  REGION 1..221: note = PD-L1 ECD v118
FTVTVPKDLYVVEYGSNMTIECKFPVEKQLDLAALIVYWEMEDKDIIQFVHGEEDLKDQHSSYRQRARLLKDQLSLGNAALQITDVKLQDAGVYRCMISYGGADYKRITVKVNAPYNKINQRILVVDPVTSEHELTCQAEGYPKAEVIWTSSDHQVLSGKTTTTNSKREEKLFNVTSTLRINTTTNEIFYCTFRRLDPEENHTAELVIPELPLAHPPNERT

SEQ ID NO: 1809 - protein, 221 aa, synthetic construct
  REGION 1..221: note = PD-L1 ECD v119
FTVTVPKDLYVVEYGSNMTIECKFPVEKQLDLAALIVYWEMEDKNIIQFVHGEEDLKVQHSSYRQRARLLKDQLSLGNAALQITDVKLQDAGVYRCMISYGGADYKRITVKVNAPYNKINQRILVVDPDTSEHELTCQAEGYPKAEVIWTSSDHQVLSGKTTTTNSKREEKLFNVTSTLRINTTTNEIFYCTFRSLDPEENHTAELVIPELPLAHPPNERT

SEQ ID NO: 1810 - protein, 221 aa, synthetic construct
  REGION 1..221: note = PD-L1 ECD v120
FTVTVPKDLYVVEYGSNMTIECKFPVEKQLDLAALIVYWEMEDKNIIQFVHGEEDLKVQHSSYRQRARLLKDQLSLGNAALQITDVKLQDAGVYRCMTSYGGADYKRITVKVNAPYNKINQRILVVDPVTSEHELTCQAEGYPKAEVIWTSSDHQVLSGKTTTTNSKREEKLYNVTSTLRINTTTNEIFYCTFRRSDPEENHTAELVIPELPLAHPPNERT

SEQ ID NO: 1811 - protein, 221 aa, synthetic construct
  REGION 1..221: note = PD-L1 ECD v121
FTVTVPKDLYVVEYGSNMTIECKFPVEKQLDLAALIVYWEMEDKDIIQFVHGEEDLKVQHSSYRQRARLLKDQLSLGNAALQITDVKLQDAGVYRCMISYGGADYKRITVKVNAPYNKINQRILVVDPVTSEHGLTCQAEGYPKAEVIWTSSDHQVLSGKTTTTNSKREEKLFNVTSTLRINTTTNEIFYCTFRRLDPEENHTAELVIPELPPAHPPNERT

SEQ ID NO: 1812 - protein, 221 aa, synthetic construct
  REGION 1..221: note = PD-L1 ECD v122
FTVTVPKDLYVVEYGSNMTIECKFPVEKQLDLAALIVYWEMEDKDIIQFVHGEEDLKVQHSSYRQRARLLKDQLSLGNAALQITDVKLQDAGVYRCMISYGGADYKRITVKVNAPYNKINQRILVVDPVTSEHELTCQAEGYPKAEVIWTSSDHQVLSGKTTTTNSKREEKLINVTCTLRINTTTNEIFYCTFRRLDPEENHTAELVIPELPLAHPPNERT

SEQ ID NO: 1813 - protein, 221 aa, synthetic construct
  REGION 1..221: note = PD-L1 ECD v123
FTVTVPKDLYVVEYGSNMTIECKFPVEKQLDLAALIVYWEMEDKDIIQFVHGEEDLKVQHSSYRQRARLLKDQLSLGNAALQITDVKLQDAGVYRCMISYGGADYKRITVKVNAPYNKINQRILVVDPVTSEHELTCQAEGYPKAEVVWTSSDHQVLSGKTTTTNSKREEKLFNVTSTLRINTTTNEIFYCTFRGLDPEENHTAELVIPELPLAHPPNERT

SEQ ID NO: 1814 - protein, 221 aa, synthetic construct
  REGION 1..221: note = PD-L1 ECD v124
FTVTVPKDLYVVEYGSNMTIECKFPVEKQLDLAALIVYWEMEDKDIIQFVHGEEDLKVQHSSYRQRARLLKDQLSLGNAALQITDVKLQDAGVYRCMISYGGADYKRITVTVNAPYNKINQRILVVDPVTSEHELTCQAEGYPKAEVIWTSSDHQVLSGKTTTTNSKREEKLFNVTSTLRINTTTNEIFYCTFRGLDPEENHTAELVIPELPLAHPPNERT

SEQ ID NO: 1815 - protein, 221 aa, synthetic construct
  REGION 1..221: note = PD-L1 ECD v125
FTVTVPKDLYVVEYGSNMTIECKFPVEKQLDLAALIVYWEMEDKDIIQFVHGEEDLKVQHSSYRQRARLLKDQLSLGNAALQITDVKLQDAGVYRCMISYGGADYKRITVKVYAPYNKINQRILVVDPVTSEHELTCQAEGYPKAEVIWTSSDHQVLSGKTTTTNSKREEKLFNVTSTLRINTTTNEIFYCTFRSLDPEENHTAELVIPELPLAHPPNERT

SEQ ID NO: 1816 - protein, 221 aa, synthetic construct
  REGION 1..221: note = PD-L1 ECD v126
FTVTVPKDLYVVEYGSNMTIECKFPVEKQLDLAALIVYWEMEDKDIIQFVHGEEDLKVQHSSYRQRARLLKDQLSLGNAALQITDVKLQDAGVYRCMISYGGADYKRITVKVNAPYNKINQRILVVDPVTSEHELTCQAEGYPKAEVIWTSSDHQVLSGKTTTTYSKREGKLFNVTSTLRINTTTNEIFYCTFRRLDPEENHTAELVIPELPLAHPPNERT

SEQ ID NO: 1817 - protein, 221 aa, synthetic construct
  REGION 1..221: note = PD-L1 ECD v127
FTVTVPKDLYVVEYGSNMTIECKFPVEKQLDLAALIVYWEMEDKDIIQFVHGEEDLKVQHSSYRQRARLLKDQLSLGNAALQITDVKLRDAGVYRCMVSYGGADYKRITVKVNAPYNKINQRILVVDPVTSEHELTCQAEGYPKAEVIWTSSDHQVLSGKTTTTNSKREEKLFNVTSTLRINTTTNEIFYCTFRRLDPEENHTAELVIPELPLAHPPNERT

SEQ ID NO: 1818 - protein, 221 aa, synthetic construct
  REGION 1..221: note = PD-L1 ECD v128
FTVTVPKDLYVVEYGSNMTIECKFPVEKQLDLAALIVYWEMEDKDIIQFVHGEEDLKVQHSSYRQRARLLKDQLSLGNAALQITDVKLQDAGVYRCMISYGGADYKRITVKVNAPYNKINQRILVVDPVTFEHELTCQAEGYPKAEVIWTSSDHQVLSGKTTTTNSKREEKLFNVTSTLRINTTTNEIFYCTFRRLDSEENHTAELVIPELPLAHPPNERT

SEQ ID NO: 1819 - protein, 221 aa, synthetic construct
  REGION 1..221: note = PD-L1 ECD v129
FTVTVPKDLYVVEYGSNMTIECKFPVEKQLDLAALIVYWEMEDKDIIQFVHGEEDLKVQHSSYRQRARLLKDQLPLGNAALQITDVKLQDAGVYRCMISYGGADYKRITVKVNAPYNKINQRILVVDPVTSEHELTCQAEGYPKAEVIWTSSDHQVLSGKTTTTNSKREEKLFNVTSTLRINTTTNEIFYCTFRRLDSEENHTAELVIPELPLAHPPNERT

SEQ ID NO: 1820 - protein, 221 aa, synthetic construct
  REGION 1..221: note = PD-L1 ECD v131
FTVTVPKDLYVVEYGSNMTIECKFPVEKQLDLAALIVYWEMEDKDIIQFAHGEEDLKVQHSSYRQRARLLKDQLSLGNAALQITDVKLQDAGVYRCMISYGGADYKRITVKVNAPYNKINQRILVVDPVTSEHELTCQAEGYPKAEVIWTSSDHQVLSGKTTTTNSKREEKLFNVTSTLRINTTTNEIFYCTFRTLDPEENHTAELVIPELPLAHPPNERT

SEQ ID NO: 1821 - protein, 221 aa, synthetic construct
  REGION 1..221: note = PD-L1 ECD v131
FTVTVPKDLYVVEYGSNMTIECKFPVDKQLDLAALIVYWEMEDKDIIQFVHGEEDLKVQHSSYRQRARLLKDQLSLGNAALQITDVKLQDAGVYRCMISYGGADYKRITVKVNAPYNKINQRILVVDPVTSEHELTCQAEGYPKAEVIWTSSDHQVLSGKTTTTNSKREEKLFNVTSTLRINATTNEVFYCTFRRLDPEENHTAELVIPELPLAHPPNERT

SEQ ID NO: 1822 - protein, 221 aa, synthetic construct
  REGION 1..221: note = PD-L1 ECD v132
FTVTVPKDLYVVEYGSNMTIECKFPVEKQLDLAALIVYWEMEDKNIIQFVHGEEDLKVQHSSYRQRARLLKDQLSLGNAALQITDVKLQDAGVYRCMISYGGADYKRITVKVNAPYNKINQRILVVDPVTSEHELTCQAEGYPKAEVIWTSSDHQVLSGKTTTTNSKREEKLYNVTSTLRINITTNEIFYCTFRRSDPEENHAAELVIPELPLAHPPNERT

SEQ ID NO: 1823 - protein, 221 aa, synthetic construct
  REGION 1..221: note = PD-L1 ECD v133
FTVTVPKDLYVVEYGSNMTIECNFPVEKQLDLAALIVYWEMEDKDIIQFVHGEEDLKVQHSSYRQRARLLKDQLPLGNAALQITDVKLQDAGVYRCMISYGGADYKRITVKVNAPYNKISQRILVVDPVTSEHELTCQAEGYPKAEVIWTSSDHQVLSGKTTTTNSKREEKLFNVTSTLRINTTTNEIFYCTFRRLDPEENHTAELVIPELPLAHPPNERT

SEQ ID NO: 1824 - protein, 221 aa, synthetic construct
  REGION 1..221: note = PD-L1 ECD v134
FTVTVPKDLYVVEYGSNMTIECKFPVEKQLDLAALIVYWEMEDKDIIQFVHGEEDLKVQHSSYRQRARLLKDQLSLGNAALQITDVKLQDAGVYRCMISYGDADYKRITVKVNAPYNKINQRILVVDPVTSEHELTCQAEGYPKAEVIWTSSDHQVLSGKTTTTNSKREEKLFNVTSTLRINTTTNEIFYCTFWGLDPEENHTAELVIPELPLAHPPNERT

SEQ ID NO: 1825 - protein, 221 aa, synthetic construct
  REGION 1..221: note = PD-L1 ECD v135
FTVTVPKDLYVVEYGSNMTIECKFPVEKQLDLAALIVYWEMEDKDIIQFVHVEEDLKVQHSSYRQRARLLKDQLSLGNAALQITDVKLQDAGVYRCMISYGGADYKRITVKVNAPYNKINLRILVVDPVTSEHELTCQAEGYPKAEVIWTSSDHQVLSGKTTTTNSKREEKLFNVTSTLRINTTTNEIFYCTFRRLDSEENHTAELVIPELPLAHPPNERT

SEQ ID NO: 1826 - protein, 221 aa, synthetic construct
  REGION 1..221: note = PD-L1 ECD v136
FTVTVPKDLYVVEYGSNMTIECKFPVEKQLDLAALIVYWEMEDKDIIQFVHGEEDLKVQHSSYRQRARLLKDQLSLGNAALQITDVKLQDAGVYRCMISYGGADYKRITVKVNAPYNKINQRILVVDPVTSEHELTCQAEGYPKAEVVWTSSDHQVLSGKTTTTNSKREEKLFNVTSTLRINTTTNEIFYCTFRGLDPEEDHTAELVIPELPLAHPPNERT

SEQ ID NO: 1827 - protein, 221 aa, synthetic construct
  REGION 1..221: note = PD-L1 ECD v137
FTVTVPKDLYVVEYGSNMTIECKFPVEKQLDLAALIVYWEMEDKDIIQFVHGEEDLKVQHSSYRQRARLLKDQLSLGNAALQITDVKLQDAGVYRCMISYGGADYKRITVTVNAPYNKINQRILVVDPVTSEHELTCQAEGYPKAEVIWTSSDHQVLSGKTTTTNSKREEKLFNVTSTLRINATTNEVFYCTFRRLDPEENHTAELVIPELPLAHPPNERT

SEQ ID NO: 1828 - protein, 221 aa, synthetic construct
  REGION 1..221: note = PD-L1 ECD v138
FTVTVPKDLYVVEYGSNMTIECKFPVEKQLDLAALIVYWEMEDKDIIQFVHGEEDLKVQHSSYRQRARLLKDQLSLGNAALQITDVKLRDAGVYRCMISYGGADYKRITVKVNAPYNKINQRILVVDPVTSEHELTCQAEGYPKAEVIWTSSDHQVLSGKTTTTNSKREEKLFNVTSTLRINTTTNEISYCTFRRLDSEENHTAELVIPELPLAHPPNERT

SEQ ID NO: 1829 - protein, 221 aa, synthetic construct
  REGION 1..221: note = PD-L1 ECD v139
FTVTVPKDLYVVEYGSNMTIECKFPVEKQLDLAALIVYWEMEDKDIIQFVHGEEDLKVQHSSYRQRARLLKDQLSLGNAALQITDVKLQDAGVYRCMIGYGGADYKRITVKVNAPYNKINQRILVVDPVTSEHELTRQAEGYPKAEVIWTSSDHQVLSGKTTTTNSKREEKLFNVTSTLRINTTTNEIFYCTFRRLDPEENHTAELAIPELPLAHPPNERT

SEQ ID NO: 1830 - protein, 221 aa, synthetic construct
  REGION 1..221: note = PD-L1 ECD v140
FTVTVPKDLYVVEYGSNMTIECKFPVEKQLDLAALIVYWEMEDKDIIQFVHGEEDLKVQHSSYRQRARLLKDQLSLGNAALQITDVKLQDAGVYRCMISYGGADYKRITVKVNAPYNKINQRILVVDPVTSEHELTCQAEGYPKAEVIWTSSDHQVLSGKTTITNSRREEKLFNVTSTLRINTTTNEIFYCTFRGLDPEENHTAELVIPELPLAHPPNERT

SEQ ID NO: 1831 - protein, 221 aa, synthetic construct
  REGION 1..221: note = PD-L1 ECD v141
FTVTVPKDLYVVEYGSNMTIECKFPVEKQLDLAALIVYWEMEDKDIIQFVHGEEDLKVQHSSYRQRARLLKDQLSLGNAALQITDVKLQDAGVYRCMISYGGADYKRITVKVNAPYNKINQRILVVDPVTSEHELTCQAEGYPKAEVIWTSSDHQVLSGKTTTTNSKREEKLFNVTSTLRINATTNEIFYCSFGRLDPEENHTAELVIPELPLAHPPNERT

SEQ ID NO: 1832 - protein, 221 aa, synthetic construct
  REGION 1..221: note = PD-L1 ECD v142
FTVTVPKDLYVVEYGSNMTIECKFPVEKQLDLAALIVYWEMEDKDIIQFAHGEEDLKVQHSSYRQRARLLKDQLSLGNAALQITDVKLQDAGVYRCMISYGGADYKRITVKVNAPYNKTNQRILVVDPVTSEHELTCQAEGYPEAEVIWTSSDHQVLSGKTTTTNSKREEKLFNVTSTLRINTTTNEIFYCTFRRLDPEENHTAELVIPELPLAHPPNERT

SEQ ID NO: 1833 - protein, 221 aa, synthetic construct
  REGION 1..221: note = PD-L1 ECD v143
FTVTVPKDLYVVEYGSNMAIECKFPVEKQLDLAALIVYWEMEDKDIIQFVHGEEDLKVQHSSYRQRARLLKDQLSLGNAALQITDVKLQDAGVYRCMISYGGADYKRITVKVNAPYNKINQRILVVDPVTSEHELTCQAEGYPEAEVIWTSSDHQVLSGKTTTTNSKREEKLFNVTSTLRINTTTNEIFYCTFRGLDPEENHTAELVIPELPLAHPPNERT

SEQ ID NO: 1834 - protein, 221 aa, synthetic construct
  REGION 1..221: note = PD-L1 ECD v144
FTVTVPKDLYEVEYGSNMTIECKFPVEKQLDLAALIVYWEMEDKDIIQFVHGEEDLKVQHSSYRQRARLLKDQLSLGNAALQITDVKLQDAGVYRCMISYGGADYKRITVKVNAPYNKINQRILVVDPVASEHELTCQAEGYPKAEVIWTSSDHQVLSGKTTTTNSKREEKLFNVTSTLRINTTTNEIFYCTFRRLDTEENHTAELVIPELPLAHPPNERT

SEQ ID NO: 1835 - protein, 221 aa, synthetic construct
  REGION 1..221: note = PD-L1 ECD v145
FTVTVPKDLYVVEYGSNMTIECKFPAEKQLDLAALIVYWEMEDKDIIQFVHGEEDLKVQHSSYRQRARLLKDQLSLGNAALQITDVKLQDAGVYRCMISYGGADYKRITVKVNAPYNKINQRILVVDPVTSEHELTCQAEGYPKAEVIWTSSDHQVLSGKTTITNSKREEKLFNVTSTLRINTTANEIFYCTFRRLDPEENHTAELVIPELPLAHPPNERT

SEQ ID NO: 1836 - protein, 221 aa, synthetic construct
  REGION 1..221: note = PD-L1 ECD v146
FTVTVPKDLYVVEYGSNMTIECNFPVEKQLDLAALIVYWEMEDKDIIQFVHGEEDLKVQHSSYRQRARLLKDQLSLGNAALQITDVKLQDAGVYRCMISYGGADYKRITVKVNAPYNKINQRISVVDPVTSEHELTCQAEGYPKAEVIWTSSDHQVLSGKTTTTNSTREEKLFNVTSTLRINTTTNEIFYCTFRGLDPEENHTAELVIPELPLAHPPNERT

SEQ ID NO: 1837 - protein, 221 aa, synthetic construct
  REGION 1..221: note = PD-L1 ECD v147
FTVTVPKDLYVVEYGSNMTIECNFPVEKQLDLAALIVYWEMEDKDIIQFVHGEEDLKVQHSSYRQRARLLKDRLSLGNAALQITDVKLQDAGVYRCMISYGGADYKRITVKVNAPYNKINQRILVVDPVTSEHELTCQAEGYPKAEVIWTSSDHQVLSGKTTITNSKREEKLFNVTSTLRINTTTNEIFYCTFRRLDPEENHTAELVIPELPLAHPPNERT

SEQ ID NO: 1838 - protein, 221 aa, synthetic construct
  REGION 1..221: note = PD-L1 ECD v148
FTVTVPKDLYVVEYGSNMTIECKFPVEEQLDLAALIVYWEMEDKDIIQFVHGEEDLKVQHSSYRQRARLLKDQLSLGNAALQITDVKLQDAGVYRCMISYGGADYKRITVKVNAPYNKINQRILVVDPVTSEHELTCQAEGYPKAEVIRTSSDHQVLGGKTTTTNSKREEKLFNVTSTLRINTTTNEIFYCTFRRLDTEENHTAELVIPELPLAHPPNERT

SEQ ID NO: 1839 - protein, 221 aa, synthetic construct
  REGION 1..221: note = PD-L1 ECD v149
FTVTVPKDLYVVEYGSNMTIECKFPVERQLDLAALIVYWEMEDKDIIQFVHGEEDLEVQHSSYRQRARLLKDQLSLGNAALQITDVKLQDAGVYRCMVSYGGADYKRITVKVNAPYNKINQRILVVDPVTSEHELTCQAEGYPKAEVIWTSSDHQVLSGKTTTTNSKREEKLFNVTSTLRINTTTNEIFYCTFRSLDPEENHTAELVIPELPLAHPPNERT

SEQ ID NO: 1840 - protein, 221 aa, synthetic construct
  REGION 1..221: note = PD-L1 ECD v150
FTVTVPKDLYVVEYGSNMTIECKFPVERQLDLAALIVYWEMEDKDIIQFVHGEEDLKVQHSSYRQRARLLKDQLSLGNAALQITDVKLQDAGVYRCMISYGGADYKRITVKVNAPYNKINQRILVVDPDTSEHELTCQAEGYPKAEVIWTSSDHQVLSGKTTNTNSKREEKLFNVTSTLRINTTTNEIFYCTFRTLDPEENHTAELVIPELPLAHPPNERT

SEQ ID NO: 1841 - protein, 221 aa, synthetic construct
  REGION 1..221: note = PD-L1 ECD v151
FTVTVPKDLYVVEYGSNMTIECKFPVEKQLDLAALIVYWEKEGKDIIQFVHGEEDLKVQHSSYSQRARLLKDQLSLGNAALQITDVKLQDAGVYRCMISYGGADYKRITVKVNAPYNKINQRILVVDPVTSEHELTCQAEGYPKAEVIWTSSDHQVLSGKTTTTNSKREEKLFNVTSTLRINTTTNEIFYCTFRGLDPEENHTAELVIPELPLAHPPNERT

SEQ ID NO: 1842 - protein, 221 aa, synthetic construct
  REGION 1..221: note = PD-L1 ECD v152
FTVTVPKDLYVVEYGSNMTIECKFPVEKQLDLAALIVYWEKEGKDIIQFVHGEEDLKVQHSSYSQRARLLKDQLSLGNAALQITDVKLQDAGVYRCMIGYGGADYKRITVKVNAPYNKINQRILVVDPVTSEHELTCQAEGYPKAEVIWTSSDHQVLSGKTTTTNSKREEKLFNVTSTLRINTTTNEIFYCTFRRLDPEENHTAELVIPELPLAHPPNERT

SEQ ID NO: 1843 - protein, 221 aa, synthetic construct
  REGION 1..221: note = PD-L1 ECD v153
FTVTVPKDLYVVEYGSNMTIECKFPVEKQLDLAALIVYWEMEDKDIIQFVHGEEDLKVQHSSYRQRALLLKDQLSLGNAALQITDVKLQDAGVYRCMISYGGADYKRITVKVNAPYNKINQRILVVDPVTSEHELTCQAEGYPKAEVIWTSSDHQVLSGKTTTTNSKREEKLLNVTSTLRINTTTNEIFYCTFRRLGSEENHTAELVIPELPLAHPPNERT

SEQ ID NO: 1844 - protein, 221 aa, synthetic construct
  REGION 1..221: note = PD-L1 ECD v154
FTVTVPKDLYVVEYGSNMTIECKFPVEKQLDLAALIVYWEMEDKDIIQFAHGEEDLKVQHSSYRQRARLLKDQLSLGNAALQITDVKLQDAGVYRCMISYGGADYKRITVKVNAPYNKINQRILVVDPVTSEHELTCQAEGYPKAEVVWTSSDHQVLSGKTTTTNSKREEKLFNVTSTLRINTTTNEIFYCTFRGLDPEEDHTAELVIPELPLAHPPNERT

SEQ ID NO: 1845 - protein, 221 aa, synthetic construct
  REGION 1..221: note = PD-L1 ECD v155
FTVTVPKDLYVVEYGSNMTIECKFPVEKQLDLAALIVYWEKEGEDIIQFVHGEEDLKVQHSSYRQRARLLKDQLSLGNAALQITDVKLQDAGVYRCMISYGGADYKRITVKVNAPYNKINQRILVVDPVTSEHELTCQAEGYPKAEVIWTSSDHQVLSGKTTTTNSKREEKLFNVTSTLRINTTTNEIFYCTFRGLDPEEDHTAELVIPELPLAHPPNERT

SEQ ID NO: 1846 - protein, 221 aa, synthetic construct
  REGION 1..221: note = PD-L1 ECD v156
FTVTVPKDLYVVEYGSNMTIECKFPVEKQLDLAALIVYWEMEDKDIIQFAHGEEDLKVQHSSYRQRARLLKDQLSLGNAALQITDVKLQDAGVYRCMISYGGADYKRITVKVNAPYNKINQRISVVDPVTSEHELTCQAEGYPEAEVIWTSSDHQVLSGKTTTTNSKREEKLFNVTSTPRINTTTNEIFYCTFRGLDPEENHTAELVIPELPLAHPPNERT

SEQ ID NO: 1847 - protein, 220 aa, synthetic construct
  REGION 1..220: note = PD-L1 ECD v67
FTVTVPKDLYVVEYGSNMTIECKFPVEKQLDLAALIVYWEMEDKNIIQFVHGEEDLRVQHSSYRQRARLLKDQLSLGNAALQITDVKLQDAGVYRCMIGYGGADYKRITVKVNAPYNKINQRILVVDPVTSEHELTCQAEGYPKAEVIWTSSDHQVLSGKTTTTNSKREEKLFNVTSTLRINTTTNEIFYCTFRRLDPEENHTAELVIPELPLAHPPNER

SEQ ID NO: 1848 - protein, 220 aa, synthetic construct
  REGION 1..220: note = PD-L1 ECD v68
FTVTVPKDLYVVEYGSNMTIECKFPVEKQLDLAALIVYWEMEDKNIIQFVHGEEDLRVQHSSYRQRARLLKDQLSLGNAALQITDVKLQDAGVYRCMIGYGGADYKRITVKVNAPYNKINQRILVVDPVTSEHELTCQAEGYPKAEVIWTSSDHQVLSGKTTTTNSKREEKLFNVTSTLRINTTTNEILYCTFRRLDPEENHTAELVIPELPLAHPPNER

SEQ ID NO: 1849 - protein, 220 aa, synthetic construct
  REGION 1..220: note = PD-L1 ECD v69
FTVTVPKDLYVVEYGSNVTIECKFPVEKQLDLAALIVYWEMEDKNIIQFVHGEEDLKVQHSSYRQRARLLKDQLSLGNAALQITDVKLQDAGVYRCLISYGGADYKRITVKVNAPYNKINQRILVVDPVTSEHELTCQAEGYPKAEVIWTSSDHQVLSGKTTTTNSKREEKLFNVTSTLRINTTTNEIFYCTSRGLDPEKNQTAELVIPELPLAHPPNER

SEQ ID NO: 1850 - protein, 220 aa, synthetic construct
  REGION 1..220: note = PD-L1 ECD v70
FTVTVPKDLYVVEYGSNMTIECKFPVEKQLDLAALSVYWEKEDKNIIQFVHGEEDLKVQHSSYRQRARLLKDQLSLGNAALQITDVKLQDAGVYRCLISYGGADYKRITVKVNAPYNKINQRILVVDPVTSEHELTCQAEGYPQAEVIWTSSDHQVLSGKTTTTNSKREEKLFNVTSTLRINTTTNEIFYCTFRGLDPEKNQTAEFVIPELPLAHPPNER

SEQ ID NO: 1851 - protein, 220 aa, synthetic construct
  REGION 1..220: note = PD-L1 ECD v72
FTVTVPKDLYVVEYGSNVTIECKFPVEKQLDLAALIVYWEMEDKNIIQFVHGEEDLKVQHSSYRQRARLLKDQLSLGNAALQITDVKLQDAGVYRCMLSYGGADYKRITVKVNAPYNKINQRISVVDPVTSEHELTCQAEGYPKAEVIWTSSDHQVLSGKTTTTNSKREEKLFNVTSTLRINTTTNEIFYCTFRRLDTEENHTAEFVIPELPLAHPPNER

SEQ ID NO: 1852 - protein, 220 aa, synthetic construct
  REGION 1..220: note = PD-L1 ECD v73
FTVTVPKDLYVVEYGSNMTIECKFPVEKQLDLAALIVYWEMEDKNIIQFVHGEEDLKVQHSSYRQRARLLKDQLSLGNAALQITDVKLQDAGVYRCMIGYGGADYKRITVKVNAPYSKINQRILVVDPVTSEHELTCQAEGYPKAEVVWTSSDHQVLSGKTTTTNSKREERLFNVTSTLSINTTTNEIFYCTFRRLDPEENHTAELVIPELPLAHPPNER

SEQ ID NO: 1853 - protein, 220 aa, synthetic construct
  REGION 1..220: note = PD-L1 ECD v74
FTVTVPKDLYVVEYGSNMTIECKFPVEKQLDLAALTVYWEMEDKNIIQFVHGEEDLKVQHSSYRQRARLLKDQLSLGNAALQITDVKLQDAGVYRCLISYGGVDYKRITVKVNAPYNKINQRILVVDPVTSEHELTCQAEGYPKAEVIWTSSDHHVLSGKTTTTNSKREEKLFNVTSTLRINTTTNEIFYCTFRRLDPEENHTAELVIPELPLAHPPNER

SEQ ID NO: 1854 - protein, 220 aa, synthetic construct
  REGION 1..220: note = PD-L1 ECD v75
FTVTVPKDLYVVEYGSNMTIECKFPVEIQLDLAALIVYWEMEDKNIIQFVHGEEDLKVQHSSYRQRARLLKDQLSLGNAALQITDVKLQDAGVYRCMIGYGGADYKRITVKVNAPYNKINQRILVVDPVTSEHELTCQAEGYPKAEVIWTSSDHQVLSGKTTTTNSKREEKLFNVTSTLRINTTTNEIFYCTFRRLDPEENHTAELVIPELPLAHPPNER

SEQ ID NO: 1855 - protein, 220 aa, synthetic construct
  REGION 1..220: note = PD-L1 ECD v76
FTVTVPKDLYVVEYGSNMTIECKFPVEKQLDLAALIVYWEMEDKNIIQFVHGEEDLKVQHSSYRQRARLLKDQLSLGNAALQITDVKLQDAGVYRCMISYGGADYKRITVKVNAPYNKINQRILVVDPVTSEHELTCQAEGYPKAEVIWTSSDHQVLSGKTTTTNSKREEKLFNVTSTLRINTTTNEIFYCTFRSLDPEENHTAELVIPELPLAHPPNER

SEQ ID NO: 1856 - protein, 220 aa, synthetic construct
  REGION 1..220: note = PD-L1 ECD v77
FTVTVPKDLYVVEYGSNMTIECKFPVEKQLDLAALIVYWEMEDKNIIQFVHGEEDLKVQHSSYRQRARLLKDQLSLGNTALQITDVKLQDAGVYRCMIGYGGADYKRITVKVNAPYNKINQRILVVDPVTSEHELTCQAEGYPKAEVIWTSSDHQVLSGKTTTTNSKREEKLFNVTSTLRINTTANEIFYCTFRGLDPEKNQTAEFVIPELPLAHPPNER

SEQ ID NO: 1857 - protein, 220 aa, synthetic construct
  REGION 1..220: note = PD-L1 ECD v78
FTVTVPKDLYVVEYGSNMTIECKFPVEKQLDLAALIVYWEMEDKNIIQFVHGEEDLRVQHSSYRQRARLLKDQLSLGNAALQITDVKLQDAGVYRCMIGYGGADYKRITVKVNAPYNKINQRISVVDPVTSEHELTCQAEGYPQAEVIWTSSDHQVLSGKTTTTNSKREEKLFNVTSTLRINTTTNEIFYCTFRRLDPEENHTAELVIPELPLAHPPNER

SEQ ID NO: 1858 - protein, 220 aa, synthetic construct
  REGION 1..220: note = PD-L1 ECD v79
FTVTVPKDLYVVEYGSNMTIECKFPVEKQLDLAALIVYWEMEDKNIIQFVHGEEDLRVQHSSYRQRARLLKDQLSLGNAALQITDVKLQDAGVYRCMIGYGGADYKRITVKVNAPYNKINQRILVVDPVTSEHELTCQAEGYPKAEVIWTSSDHQVLSGKTTTTNSKREEKLFNVTSTLRINTTTNEIFYCTFRGLDPEENHTAELVIPELPLAHPPNER

SEQ ID NO: 1859 - protein, 220 aa, synthetic construct
  REGION 1..220: note = PD-L1 ECD v80
FTVTVPKDLYVVEYGSNMTIECKFPVEKQLDLAALIVYWEMEDKNIIQFVHGEEVLKVQHSSYRQRARLLKDQLSLGNAALQITDVKLQDAGVYRCLIGYGGADYKRITVKVNAPYNKINQRILVVDPVTSEHELTCQAEGYPKAEVIWTSSDHQVLSGKTTTTNSKREEKLFNVTSTLRINTTTNEIFYCTFRRLDPEENHTAELVIPELPLAHPPNER

SEQ ID NO: 1860 - protein, 220 aa, synthetic construct
  REGION 1..220: note = PD-L1 ECD v81
FTVTVPKDLYVVEYGSNMTIECKFPVGKQLDLAALTVYWEMEDKNIIQFVHGEENLKVQHSSYRQRARLLKDQLSLGNAALQITDVKLQDAGVYRCLISYGGADYKRITVEVNAPYNKINQRILVVDPVTSEHELTCQAEGYPKAEVIWTSSDHQVLSGKTTTTNSKREEKLFNVTSTLRINTTTNEIFYCTFRRLDPEENHTAELVIPELPLAHPPNER

SEQ ID NO: 1861 - protein, 220 aa, synthetic construct
  REGION 1..220: note = PD-L1 ECD v82
FTVTVPKDLYVVEYGSNMTIECKFPVEKQLDLAALIVYWEMEDKNIIQFVHGEGDLKVQHSSYRQRARLLKDQLSLGNAALQITDVKLQDAGVYRCLIGYGGADYKRITVKVNAPYNKINQRILVVDPVTSEHELTCQAEGYPKAEVIWTSSDHQVLSGKTTTTNSKREEKLFNVTSTLRINTTTNEIFYCTFRRLDPEENHTAELVIPELPLAHPPNER

SEQ ID NO: 1862 - protein, 220 aa, synthetic construct
  REGION 1..220: note = PD-L1 ECD v83
FTVTVPKDLYVVEYASNMTIECKFPVEKQLDLAALTVYWEMEDKNIIQFVHGEEDLKVQHSSYRQRARLLKDQLSLGNAALQITDVKLQDAGVYRCLISYGGADYKRITVEVNAPYNKINQRILVVDPVTSEHELTCQAEGYPKAEVIWTSSDHQVLSGKTTTTNSKREEKLFNVTSTLRINTTTNEIFYCTFRRLDPEENQTAELVIPELPLAHPPNER

SEQ ID NO: 1863 - protein, 220 aa, synthetic construct
  REGION 1..220: note = PD-L1 ECD v84
FTVTVPKDLYVVEYASNMTIECKFPVEKQLDLAALTVYWEMEDKNIIQFVHGEEDLKVQHSSYRQRARLLKDQLSLGNAALQITDVKLQDAGVYRCMISYGGADYKRITVKVNAPYNKINQRILVVDPDTSEHELTCQAEGYPKAEVIWTSSDHQVLSGKTTTTNSKREEKLFNVTSTLRINTTTNEIFYCTFRRLDPEENHTAELVIPELPLAHPPNER

SEQ ID NO: 1864 - protein, 220 aa, synthetic construct
  REGION 1..220: note = PD-L1 ECD v85
FTVTVPKDLYVVEYASNMTIECKFPVEKQLDLAALTVYWEMEDKNIIQFVHGEEDLKVQHSSYRQRARLLKDQLSLGNAALQITDVKLQDAGVYRCMISYGGADYKRITVKVNAPYNKINQRILVVDPDTSEHELTCQAEGYPKAEVIWTSSDHQVLSGKTTTTNSKREEKLFNVTSTLRINTTTNEIFYCTFRGLDPEENHTAELVIPELPLAHPPNER

SEQ ID NO: 1865 - protein, 220 aa, synthetic construct
  REGION 1..220: note = PD-L1 ECD v86
FTVTVPKDLYVVEYASNMTIECKFPVEKQLDLAALIVYWEMEDKNIIQFVHGEEDLKVQHSSYRQRARLLKDQLSLGNAALQITDVKLQDAGVYRCMISYGGADYKRITVKVNAPYNKINQRILVVDPDTSEHELTCQAEGYPKAEVIWTSSDHQVLSGKTTTTNSKREEKLFNVTSTLRINTTTNEIFYCTFRRLDPEENHTAELVIPELPLAHPPNER

SEQ ID NO: 1866 - protein, 220 aa, synthetic construct
  REGION 1..220: note = PD-L1 ECD v87
FTVTVPKDLYVVEYGSNMTIECKFPVEKQLDLAALSVYWEMEDKNIIQFVHGEEDLKVQHSSYRQRARLLKDQLSLGNAALQITDVKLQDAGVYRCLISYGGADYKRITVKVNAPYNKINQRILVVDPVTSEHELTCQAEGYPKAEVIWTSSDHQVLSGKTTTTNSKREEKLFNVTSTLRINTTTNEIFYCTFRRLDPEENHTAELVIPELPLAHPPNER

SEQ ID NO: 1867 - protein, 220 aa, synthetic construct
  REGION 1..220: note = PD-L1 ECD v88
FTVTVPKDLYVVEYGSNMTIECKFPVEKQLDLAALTVYWEMEDKNIIQFVHGEENLKVQHSSYRQRARLLKDQLSLGNAALQITDVKLQDAGVYRCLISYGGADYKRITVEVNAPYNKINQRILVVDPVTSEHELTCQAEGYPKAEVIWTSSDHQVLSGKTTTTNSKREEKLFNVTSTLRINTTTNEIFYCTFRRLDPEENHTTELVIPELPLAHPPNER

SEQ ID NO: 1868 - protein, 220 aa, synthetic construct
  REGION 1..220: note = PD-L1 ECD v89
FTVTVPKDLYVVEYGSNMTIECKFPVEKQLDLAALTVYWEMEDKNIIQFVHGEENLKVQHSSYRQRARLLKDQLSLGNAALQITDVKLQDAGVYRCLISYGGADYKRITVEVNAPYNKINQRILVVDPATSEHELTCQAEGYPKAEVIWTSSDHQVLSGKTTTTNSKREEKLLNVTSTLRINTTTNEIFYCTFRRLDPEENHTAELVIPELPLAHPPNER

SEQ ID NO: 1869 - protein, 220 aa, synthetic construct
  REGION 1..220: note = PD-L1 ECD v90
FTVTVPKDLYVVEYGSNMTIECKFPVEKQLDLAALTVYWEMEDKNIIQFVHGEESLKVQHSSYRQRARLLKDQLSLGNAALQITDVKLQDAGVYRCLISYGGADYKRITVEVNAPYNKINQRILVVDPVTSEHELTCQAEGYPKAEVVWTSSDHQVLSGKTTTTNSKREEKLFNVTSTLSINTTTNEIFYCTFRRLDPEENHTAELVIPELPLAHPPNER

SEQ ID NO: 1870 - protein, 220 aa, synthetic construct
  REGION 1..220: note = PD-L1 ECD v91
FTVTVPKDLYVVEYGSNMTIECKFPVEKQLDLAALTVYWEMEDKNIIQFVHREEDLKVQHSSYRQRARLLKDQLSLGNAALQITDVKLQDAGVYRCLISYGGADYKRITVKANAPYNKINQRILVVDPVTSEHELTCQAEGYPEAEVIWTSSDHQVLSGKTTTTNSKREEKLFNATSTLRINTTTNEIFYCTFRRLDTEENHTAELVIPELPLAHPPNER

SEQ ID NO: 1871 - protein, 220 aa, synthetic construct
  REGION 1..220: note = PD-L1 ECD v92
FTVTVPKDLYVVEYGSNMTIECKFPVEKQLDLAALTVYWEMEDKNVIQFVHGEEGLKVQHSSYRQRARLLKDQLSLGNAALQITDVKLQDAGVYRCLISYGGADYERITVKVNAPYNKINQRILVVDPVTSEHELTCQAEGYPEAEVIWTSSDHQVLSGKTTTTNSKREEKLFNVTSTLRINTTANEIFYCTFRGLDPEENHTAELVIPELPLAHPPNER

SEQ ID NO: 1872 - protein, 220 aa, synthetic construct
  REGION 1..220: note = PD-L1 ECD v93
FTVTVPKDLYVVEYGSNMTIECKFPVEKQLDLAALTVYWEMEDKNIIQFVHGEEDLKVQHSSYRQRARLLKDQLSLGNAALQTTDVKLQDAGVYRCLISYGGADYKRITVKVNAPYNKINQRILVVDPVTSEHELTCQAEGYPEAEVIWTSSDHQVLSGKTTTTNSKREEKLFNVTSTLRINTTTNEIFYCTFRRLDTEENHTAELVIPELPLAHPPNER

SEQ ID NO: 1873 - protein, 220 aa, synthetic construct
  REGION 1..220: note = PD-L1 ECD v94
FTVTVPKDLYVVEYGSNMTIECKFPVEKQLDLAALTVYWEMEDKNIIQFVHGEEDLKVQHSSYRQRARLLKDQLSLGNAALQITDVKLQDAGVYRCLISYGGADYKRITVEVNAPYNKINQRILVVDPVTSEHELTCQAEGYPKAEVIWTSSDHQVLSGKTTTTNSKREEKLFNVTSTLRINTTTNEIFYCTFRRLDPEENHTAELVIPELPLAHPPNER

SEQ ID NO: 1874 - protein, 220 aa, synthetic construct
  REGION 1..220: note = PD-L1 ECD v95
FTVTVPKDLYVVEYGSNMTIECKFPVEKQLDLAALTVYWEMEDKNIIQFVHGEEDLKVQHSSYRQRARLLKDQLSLGNAALQITDVKLQDAGVYRCLISYGGADYKRITVKVNAPYNKINQRILVVDPVTSEHELTCQAEGYPEAEVIWTSSDHQVLSGKTTTTNSKREEKLFNVTSTLRINTTTNEIFYCTFRRLDTEENHTAELVIPELPLAHPPNER

SEQ ID NO: 1875 - protein, 220 aa, synthetic construct
  REGION 1..220: note = PD-L1 ECD v96
FTVTVPKDLYVVEYGSNMTIECKFPVEKQLDLAALTVYWEMEDKNIIQFVHGEEDLKVQHSSYRQRARLLKDQLSLGNAALQITDVKLQDAGVYRCLISYGGADYKRITVKVNAPYNKINQRILVVDPVTSEHELTCQAEGYPKAEVIWTSSDHHVLSGKTTTTNSKREEKLFNVTSTLRINTTTNEIFYCTSRRLDPEEYHTAELVIPELPLAHPPNER

SEQ ID NO: 1876 - protein, 220 aa, synthetic construct
  REGION 1..220: note = PD-L1 ECD v97
FTVTVPKDLYVVEYGSNMTIECKFPVEKQLDLAALTVYWEMEDKNIIQFVHGEEDLKVQHSSYRQRARLLKDQLSLGNAALQITDVKLQDAGVYRCLISYGGADYKRITVKVNAPYNKINQRILVVDPDTSEHELTCQAEGYPKAEVIWTSSDHQVLSGKTTTTNSKREEKLFNVTSTLRINTTTNEIFYCTFRRLDPEENHTAELVIPELPLAHPPNER

SEQ ID NO: 1877 - protein, 220 aa, synthetic construct
  REGION 1..220: note = PD-L1 ECD v98
FTVTVPKDLYVVEYGSNMTIECKFPVEKQLDLAAPSVYWEMEDKNIIQFVHGEEDLKVQHSSYRQRARLLKDQLSLGNAALQITDVKLQDAGVYRCLISYGGADYKRITVEVNAPYNKINQRILVVDPVTSEHELTCQAEGYPKAEVIWTSSDHQVLSGKTTTTNSKREEKLFNVTSTLRINTTTNEIFYCTFRRLDPEENHTAELVIPELPLAHPPNER

SEQ ID NO: 1878 - protein, 220 aa, synthetic construct
  REGION 1..220: note = PD-L1 ECD v99
FTVTVPKDLYVVEYGSNITIECKFPVEKQLDLAALTVYWEMEDKNIIQFVHGGEDLKVQHSSYRQRARLLKDQLSLGNAALQITDVKLQDAGVYRCLISYGGADYKRITVKVNAPYNKINQRILVVDPVTSEHELTCQAEGYPEAEVIWTSSDHQVLSGKTTTTNSKREEKLFNVTSTLRINTTTNEIFYCTFRRLDPGENHTAELAIPELPLAHPPNER

SEQ ID NO: 1879 - protein, 220 aa, synthetic construct
  REGION 1..220: note = PD-L1 ECD v100
FTVTVPKDLYVVEYGSNTTIECKFPVEKQLDLAALTVYWEMEDKNIIQFVHGEENLKVQHSSYRQRARLLKDQLSLGNAALQITDVKLQDAGVYRCLISYGGADYKRITVEVNAPYNKINQRILVVDPVTSEHELTCQAEGYPKAEVIWTSSDHQVLSGKTTTTNSKREEKLFNVTSTLRINTTTNEIFYCTFRRLDPEENHTAELVIPELPLAHPPNER

SEQ ID NO: 1880 - protein, 220 aa, synthetic construct
  REGION 1..220: note = PD-L1 ECD v101
FTVTVPKDLYVVEYGSNVTIECKFPVEKQLDLAALIVYWEMEDKNIIQFVHGEEDLKVQHSSYRQRARLLKDQLSLGNAALQITDVKLQDAGVYRCLISYGGADYKRITVKVNAPYNKINQRILVVDPVTSEHELTCQAEGYPKAEVIWTSSDHQVLSGKTTTTNSKREEKLFNVNSTLRINTTTNEIFYCTFRGLDPEENHTAELVIPELPLAHPPNER

SEQ ID NO: 1881 - protein, 220 aa, synthetic construct
  REGION 1..220: note = PD-L1 ECD v102
FTVTVPKDLYVVEYGSNMTIECKFPVEKQLDLAALIVYWEMEDKNIIQFVHGEEDLKVQHSSYRQRARLLKDQLSLGNAALQITDVKLQDAGVYRCLIGYGGADYKRITVKVNAPYNKINQRILVVDPVTSEHELTCQAEGYPKAEVIWTSSDHQVLSGKTTTTNSKREEKLFNVTSTLRINTTTNEIFYCTFRRLDPEENHTAELVIPELPLAHPPNER

SEQ ID NO: 1882 - protein, 220 aa, synthetic construct
  REGION 1..220: note = PD-L1 ECD v103
FTVTVPKDLYVVEYGSDMTIECKFPVEKQLDLAALIVYWEMEDKNIIQFVHGEEDLKVQHSSYRQRARLLKDQLSLGNAALQITDVKLQDAGVYRCLIGYGGADYKRITVKVNAPYNKINQRILVVDPVTSEHELTCQAEGYPKAEVIWTSSDHQVLSGKTTTTNSKREEKLFNVTSTLRINTTTNEIFYCTFRRLDPEENHTAELVIPELPLAHPPNER

SEQ ID NO: 1883 - protein, 220 aa, synthetic construct
  REGION 1..220: note = PD-L1 ECD v104
FTVTVPKDLYVVEYGSNMTIECKFPVEKQLDLAALIVYWEMEDKNIIQFVHGEEDLKVQHSSYRQRARLLKDQLSLGNAALQITDVKLQDAGVYRCMIGYGGADYKRITVKVNAPYNKINQRILVVDPVTSEHELTCQAEGYPKAEVIWTSSDHQVLSGKTTTTNSKREEKLFNVTSTLRINTTANEIFYCTFRGLDTEENHTAELVIPELPLAHPPNER

SEQ ID NO: 1884 - protein, 220 aa, synthetic construct
  REGION 1..220: note = PD-L1 ECD v105
FTVTVPKDLYVVEYGSNMTIECKFPVEKQLDLAALIVYWEMEDKNIIQFVHGEEDLKVQHSSYRQRARLLKDQLSLGNAALQITDVKLQDAGVYRCMISYGGADYKRITVKVNAPYNKINQRILVVDPDTSEHELTCQAEGYPKAEVIWTSSDHQVLSGKTTTTNSKREEKLFNVTSTLRINTTTNEIFYCTFRRLDPEENQTAELVIPELPLAHPPNER

SEQ ID NO: 1885 - protein, 220 aa, synthetic construct
  REGION 1..220: note = PD-L1 ECD v106
FTVTVPKDLYVVEYGSNMTIECKFPVEKQLDLAALIVYWEMEDKNIIQFVHGEEDLKVQHSSYRQRARLLKDQLSLGNAALQITDVKLQDAGVYRCMISYGGADYKRITVKVNAPYNKINQRILVVDPDTSEHELTCQAEGYPKAEVIWTSSDHQVLSGKTTTTNSKREEKLFNVTSTLRINTTTNEIFYCTFRRLDTEENHTAELVIPELPLAHPPNER

SEQ ID NO: 1886 - protein, 220 aa, synthetic construct
  REGION 1..220: note = PD-L1 ECD v107
FTVTVPKDLYVVEYGSNMTIECKFPVEKQLDLAALIVYWEMEDKNIIQFVHGEEDLKVQHSSYRQRARLLKDQLSLGNAALQITDVKLQDAGVYRCMISYGGADYKRITVKVNAPYNKINQRILVVDPDTSEHELTCQAEGYPKAEVIWASSDHQVLSGKTTTTNSKREEKLFNVTSTLRINTTTNEIFYCTFRRLDPEENHTAELVIPELPLAHPPNER

SEQ ID NO: 1887 - protein, 220 aa, synthetic construct
  REGION 1..220: note = PD-L1 ECD v108
FTVTVPKDLYVVEYGSNMTIECKFPVEKQLDLAALIVYWEMEDKNIIQFVHGEEDLKVQHSSYRQRARLLKDQLSLGNAALQITDVKLQDAGEYRCMISYGGADYKRITVKVNAPYNKINQRILVVDPDTSEHELTCQAEGYPKAEVIWTSSDHQVLSGKTTTTNSKREEKLFNVTSTLRINTTTNEIFYCTFRRLDPEENHTAELVIPELPLAHPPNER

SEQ ID NO: 1888 - protein, 220 aa, synthetic construct
  REGION 1..220: note = PD-L1 ECD v109
FTVTVPKDLFVVEYGSNVTIECKFPVEKQLDLAALIVYWEMEDKNIIQFVHGEEDLKVQHSSYRQRARLLKDQLSLGNAALQITDVKLQDAGVYRCMIGYGGADYKRITVKVNAPYNKINQRILVVDPVTSEHELTCRAEGYPKAEVIWTSSDHQVLSGKTTTTNSKREEKLFNVTSTLRINTTTNEIFYCTFRRLDPEENHAAELVIPELPLAHPPNER

SEQ ID NO: 1889 - protein, 220 aa, synthetic construct
  REGION 1..220: note = PD-L1 ECD v110
FTVTVPKDLYVVEYGSNMTIECKFPVEKQLDLAALIVYWEMEDKDIIQFVHGEEDLKVQHSSYRQRARLLKDQLSLGNAALQITDVKLQDAGVYRCMISYGGADYKRITVKVNAPYNKINQRILVVDPVTSEHELTCQAEGYPKAEVIWTSSDHQVLSGKTTTTNSKREEKLFNVTSTLRINTTTNEIFYCTFRRLDPEENHTAELVIPELPLAHPPNER

SEQ ID NO: 1890 - protein, 220 aa, synthetic construct
  REGION 1..220: note = PD-L1 ECD v111
FTVTVPKDLYVVEYGSNMTIECKFPVEKQLDLAALIVYWEMEDKNIIQFVHGEEDLKVQHSSYRQRARLLKDQLSLGNAALQITDVKLQDAGVYRCMISYGGADYKRITVKVNAPYNKINQRILVVDPVTSEHELTCQAEGYPKAEVIWTSSDHQVLSGMTTTTNSKREEKLFNVTSTLRINTTTNEIFYCTFRGLDPEENHTAELVIPELPLAHPPNER

SEQ ID NO: 1891 - protein, 220 aa, synthetic construct
  REGION 1..220: note = PD-L1 ECD v112
FTVTVPKDLYVVEYGSNMTIECKFPVEKQLDLAALIVYWEMEDKDIIQFVHGEEDLKVQHSSYRQRARLLKDQLSLGNAALQITDVKLQDAGVYRCMISYGGADYKRITVKVNAPYNKINQRILVVDPVTSEHELTCQAEGYPEAEVIWTSSDHQVLSGKTTTTNSKREEKLFNVTSTLRINTTTNEIFYCTFRRLDPEENHTAELVIPELPLAHPPNER

SEQ ID NO: 1892 - protein, 220 aa, synthetic construct
  REGION 1..220: note = PD-L1 ECD v113
FTVTVPKDLYVVEYGSNMTIECKFPVEKQLDLAALIVYWEMEDKDIIQFVHGEEDLKVQHSSYRQRARLLKDQLSLGNAALQITDVKLQDAGVYRCMISYGGADYKRITVKVNAPYNKINQRILVVDPVTSEHELTCQAEGYPKAEVIWTSSDHQVLSGKTTTTNSKREEKLFNVTSTLRINTTTNEIFYCTFRRLDSEENHTAELVIPELPLAHPPNER

SEQ ID NO: 1893 - protein, 220 aa, synthetic construct
  REGION 1..220: note = PD-L1 ECD v114
FTVTVPKDLYVVEYGSNMTIECKFPVEKQLDLAALIVYWEMEDKDIIQFVHGEEDLKVQHSSYRQRARLLKDQLSLGNAALQITDVKLQDAGVYRCMISYGGADYKRITVKVNAPYNKINQRILVVDPVTSEHELTCQAEGYPKAEVIWTSSDHQVLSGKTTTTNSKREEKLFNVTSTLRINTTTNEIFYCTFRRLDTEENHTAELVIPELPLAHPPNER

SEQ ID NO: 1894 - protein, 220 aa, synthetic construct
  REGION 1..220: note = PD-L1 ECD v115
FTVTVPKDLYVVEYGSNMTIECKFPVEKQLDLAALIVYWEMEDKDIIQFVHGEEDLKVQHSSYRQRARLLKDQLSLGNAALQITDVKLQDAGVYRCMISYGGADYKRITVKVNAPYNKINQRILVVDPVTSEHELTCQAEGYPKAEVIWTSSDHQVLSGKTTTTNSKREEKLFNVTSTLRINTTTNEIFYCTFRGLDPEENHTAELVIPELPLAHPPNER

SEQ ID NO: 1895 - protein, 220 aa, synthetic construct
  REGION 1..220: note = PD-L1 ECD v116
FTVTVPKDLYVVEYGSNMTIECKFPVEKQLDLAALIVYWEMEDKDIIQFVHGEEDLKVQHSSYRQRARLLKDQLSLGNAALQITDVKLQDAGVYRCMISYGGADYKRITVKVNAPYNKINQRILVVDPVTSEHELTCQAEGYPKAEVIWTSSDHQVLSGKTTTTNSKREEKLFNVTSTLRINTTTNEIFYCTFRSLDPEENHTAELVIPELPLAHPPNER

SEQ ID NO: 1896 - protein, 220 aa, synthetic construct
  REGION 1..220: note = PD-L1 ECD v117
FTVTVPKDLYVVEYGSNMTIECKFPVEKQLDLAALIVYWEMEDKDIIQFVHGEEDLKVQHSSYRQRARLLKDQLSLGNAALQITDVKLQDAGVYRCMISYGGADYKRITVKVNAPYNKINQRILVVDPVTFEHELTCQAEGYPKAEVIWTSSDHQVLSGKTTTTNSKREEKLFNVTSTLRINTTTNEIFYCTFRRLDPEENHTAELVIPELPLAHPPNER

SEQ ID NO: 1897 - protein, 220 aa, synthetic construct
  REGION 1..220: note = PD-L1 ECD v118
FTVTVPKDLYVVEYGSNMTIECKFPVEKQLDLAALIVYWEMEDKDIIQFVHGEEDLKDQHSSYRQRARLLKDQLSLGNAALQITDVKLQDAGVYRCMISYGGADYKRITVKVNAPYNKINQRILVVDPVTSEHELTCQAEGYPKAEVIWTSSDHQVLSGKTTTTNSKREEKLFNVTSTLRINTTTNEIFYCTFRRLDPEENHTAELVIPELPLAHPPNER

SEQ ID NO: 1898 - protein, 220 aa, synthetic construct
  REGION 1..220: note = PD-L1 ECD v119
FTVTVPKDLYVVEYGSNMTIECKFPVEKQLDLAALIVYWEMEDKNIIQFVHGEEDLKVQHSSYRQRARLLKDQLSLGNAALQITDVKLQDAGVYRCMISYGGADYKRITVKVNAPYNKINQRILVVDPDTSEHELTCQAEGYPKAEVIWTSSDHQVLSGKTTTTNSKREEKLFNVTSTLRINTTTNEIFYCTFRSLDPEENHTAELVIPELPLAHPPNER

SEQ ID NO: 1899 - protein, 220 aa, synthetic construct
  REGION 1..220: note = PD-L1 ECD v120
FTVTVPKDLYVVEYGSNMTIECKFPVEKQLDLAALIVYWEMEDKNIIQFVHGEEDLKVQHSSYRQRARLLKDQLSLGNAALQITDVKLQDAGVYRCMTSYGGADYKRITVKVNAPYNKINQRILVVDPVTSEHELTCQAEGYPKAEVIWTSSDHQVLSGKTTTTNSKREEKLYNVTSTLRINTTTNEIFYCTFRRSDPEENHTAELVIPELPLAHPPNER

SEQ ID NO: 1900 - protein, 220 aa, synthetic construct
  REGION 1..220: note = PD-L1 ECD v121
FTVTVPKDLYVVEYGSNMTIECKFPVEKQLDLAALIVYWEMEDKDIIQFVHGEEDLKVQHSSYRQRARLLKDQLSLGNAALQITDVKLQDAGVYRCMISYGGADYKRITVKVNAPYNKINQRILVVDPVTSEHGLTCQAEGYPKAEVIWTSSDHQVLSGKTTTTNSKREEKLFNVTSTLRINTTTNEIFYCTFRRLDPEENHTAELVIPELPPAHPPNER

SEQ ID NO: 1901 - protein, 220 aa, synthetic construct
  REGION 1..220: note = PD-L1 ECD v122
FTVTVPKDLYVVEYGSNMTIECKFPVEKQLDLAALIVYWEMEDKDIIQFVHGEEDLKVQHSSYRQRARLLKDQLSLGNAALQITDVKLQDAGVYRCMISYGGADYKRITVKVNAPYNKINQRILVVDPVTSEHELTCQAEGYPKAEVIWTSSDHQVLSGKTTTTNSKREEKLINVTCTLRINTTTNEIFYCTFRRLDPEENHTAELVIPELPLAHPPNER

SEQ ID NO: 1902 - protein, 220 aa, synthetic construct
  REGION 1..220: note = PD-L1 ECD v123
FTVTVPKDLYVVEYGSNMTIECKFPVEKQLDLAALIVYWEMEDKDIIQFVHGEEDLKVQHSSYRQRARLLKDQLSLGNAALQITDVKLQDAGVYRCMISYGGADYKRITVKVNAPYNKINQRILVVDPVTSEHELTCQAEGYPKAEVVWTSSDHQVLSGKTTTTNSKREEKLFNVTSTLRINTTTNEIFYCTFRGLDPEENHTAELVIPELPLAHPPNER

SEQ ID NO: 1903 - protein, 220 aa, synthetic construct
  REGION 1..220: note = PD-L1 ECD v124
FTVTVPKDLYVVEYGSNMTIECKFPVEKQLDLAALIVYWEMEDKDIIQFVHGEEDLKVQHSSYRQRARLLKDQLSLGNAALQITDVKLQDAGVYRCMISYGGADYKRITVTVNAPYNKINQRILVVDPVTSEHELTCQAEGYPKAEVIWTSSDHQVLSGKTTTTNSKREEKLFNVTSTLRINTTTNEIFYCTFRGLDPEENHTAELVIPELPLAHPPNER

SEQ ID NO: 1904 - protein, 220 aa, synthetic construct
  REGION 1..220: note = PD-L1 ECD v125
FTVTVPKDLYVVEYGSNMTIECKFPVEKQLDLAALIVYWEMEDKDIIQFVHGEEDLKVQHSSYRQRARLLKDQLSLGNAALQITDVKLQDAGVYRCMISYGGADYKRITVKVYAPYNKINQRILVVDPVTSEHELTCQAEGYPKAEVIWTSSDHQVLSGKTTTTNSKREEKLFNVTSTLRINTTTNEIFYCTFRSLDPEENHTAELVIPELPLAHPPNER

SEQ ID NO: 1905 - protein, 220 aa, synthetic construct
  REGION 1..220: note = PD-L1 ECD v126
FTVTVPKDLYVVEYGSNMTIECKFPVEKQLDLAALIVYWEMEDKDIIQFVHGEEDLKVQHSSYRQRARLLKDQLSLGNAALQITDVKLQDAGVYRCMISYGGADYKRITVKVNAPYNKINQRILVVDPVTSEHELTCQAEGYPKAEVIWTSSDHQVLSGKTTTTYSKREGKLFNVTSTLRINTTTNEIFYCTFRRLDPEENHTAELVIPELPLAHPPNER

SEQ ID NO: 1906 - protein, 220 aa, synthetic construct
  REGION 1..220: note = PD-L1 ECD v127
FTVTVPKDLYVVEYGSNMTIECKFPVEKQLDLAALIVYWEMEDKDIIQFVHGEEDLKVQHSSYRQRARLLKDQLSLGNAALQITDVKLRDAGVYRCMVSYGGADYKRITVKVNAPYNKINQRILVVDPVTSEHELTCQAEGYPKAEVIWTSSDHQVLSGKTTTTNSKREEKLFNVTSTLRINTTTNEIFYCTFRRLDPEENHTAELVIPELPLAHPPNER

SEQ ID NO: 1907 - protein, 220 aa, synthetic construct
  REGION 1..220: note = PD-L1 ECD v128
FTVTVPKDLYVVEYGSNMTIECKFPVEKQLDLAALIVYWEMEDKDIIQFVHGEEDLKVQHSSYRQRARLLKDQLSLGNAALQITDVKLQDAGVYRCMISYGGADYKRITVKVNAPYNKINQRILVVDPVTFEHELTCQAEGYPKAEVIWTSSDHQVLSGKTTTTNSKREEKLFNVTSTLRINTTTNEIFYCTFRRLDSEENHTAELVIPELPLAHPPNER

SEQ ID NO: 1908 - protein, 220 aa, synthetic construct
  REGION 1..220: note = PD-L1 ECD v129
FTVTVPKDLYVVEYGSNMTIECKFPVEKQLDLAALIVYWEMEDKDIIQFVHGEEDLKVQHSSYRQRARLLKDQLPLGNAALQITDVKLQDAGVYRCMISYGGADYKRITVKVNAPYNKINQRILVVDPVTSEHELTCQAEGYPKAEVIWTSSDHQVLSGKTTTTNSKREEKLFNVTSTLRINTTTNEIFYCTFRRLDSEENHTAELVIPELPLAHPPNER

SEQ ID NO: 1909 - protein, 220 aa, synthetic construct
  REGION 1..220: note = PD-L1 ECD v131
FTVTVPKDLYVVEYGSNMTIECKFPVEKQLDLAALIVYWEMEDKDIIQFAHGEEDLKVQHSSYRQRARLLKDQLSLGNAALQITDVKLQDAGVYRCMISYGGADYKRITVKVNAPYNKINQRILVVDPVTSEHELTCQAEGYPKAEVIWTSSDHQVLSGKTTTTNSKREEKLFNVTSTLRINTTTNEIFYCTFRTLDPEENHTAELVIPELPLAHPPNER

SEQ ID NO: 1910 - protein, 220 aa, synthetic construct
  REGION 1..220: note = PD-L1 ECD v131
FTVTVPKDLYVVEYGSNMTIECKFPVDKQLDLAALIVYWEMEDKDIIQFVHGEEDLKVQHSSYRQRARLLKDQLSLGNAALQITDVKLQDAGVYRCMISYGGADYKRITVKVNAPYNKINQRILVVDPVTSEHELTCQAEGYPKAEVIWTSSDHQVLSGKTTTTNSKREEKLFNVTSTLRINATTNEVFYCTFRRLDPEENHTAELVIPELPLAHPPNER

SEQ ID NO: 1911 - protein, 220 aa, synthetic construct
  REGION 1..220: note = PD-L1 ECD v132
FTVTVPKDLYVVEYGSNMTIECKFPVEKQLDLAALIVYWEMEDKNIIQFVHGEEDLKVQHSSYRQRARLLKDQLSLGNAALQITDVKLQDAGVYRCMISYGGADYKRITVKVNAPYNKINQRILVVDPVTSEHELTCQAEGYPKAEVIWTSSDHQVLSGKTTTTNSKREEKLYNVTSTLRINITTNEIFYCTFRRSDPEENHAAELVIPELPLAHPPNER

SEQ ID NO: 1912 - protein, 220 aa, synthetic construct
  REGION 1..220: note = PD-L1 ECD v133
FTVTVPKDLYVVEYGSNMTIECNFPVEKQLDLAALIVYWEMEDKDIIQFVHGEEDLKVQHSSYRQRARLLKDQLPLGNAALQITDVKLQDAGVYRCMISYGGADYKRITVKVNAPYNKISQRILVVDPVTSEHELTCQAEGYPKAEVIWTSSDHQVLSGKTTTTNSKREEKLFNVTSTLRINTTTNEIFYCTFRRLDPEENHTAELVIPELPLAHPPNER

SEQ ID NO: 1913 - protein, 220 aa, synthetic construct
  REGION 1..220: note = PD-L1 ECD v134
FTVTVPKDLYVVEYGSNMTIECKFPVEKQLDLAALIVYWEMEDKDIIQFVHGEEDLKVQHSSYRQRARLLKDQLSLGNAALQITDVKLQDAGVYRCMISYGDADYKRITVKVNAPYNKINQRILVVDPVTSEHELTCQAEGYPKAEVIWTSSDHQVLSGKTTTTNSKREEKLFNVTSTLRINTTTNEIFYCTFWGLDPEENHTAELVIPELPLAHPPNER

SEQ ID NO: 1914 - protein, 220 aa, synthetic construct
  REGION 1..220: note = PD-L1 ECD v135
FTVTVPKDLYVVEYGSNMTIECKFPVEKQLDLAALIVYWEMEDKDIIQFVHVEEDLKVQHSSYRQRARLLKDQLSLGNAALQITDVKLQDAGVYRCMISYGGADYKRITVKVNAPYNKINLRILVVDPVTSEHELTCQAEGYPKAEVIWTSSDHQVLSGKTTTTNSKREEKLFNVTSTLRINTTTNEIFYCTFRRLDSEENHTAELVIPELPLAHPPNER

SEQ ID NO: 1915 - protein, 220 aa, synthetic construct
  REGION 1..220: note = PD-L1 ECD v136
FTVTVPKDLYVVEYGSNMTIECKFPVEKQLDLAALIVYWEMEDKDIIQFVHGEEDLKVQHSSYRQRARLLKDQLSLGNAALQITDVKLQDAGVYRCMISYGGADYKRITVKVNAPYNKINQRILVVDPVTSEHELTCQAEGYPKAEVVWTSSDHQVLSGKTTTTNSKREEKLFNVTSTLRINTTTNEIFYCTFRGLDPEEDHTAELVIPELPLAHPPNER

SEQ ID NO: 1916 - protein, 220 aa, synthetic construct
  REGION 1..220: note = PD-L1 ECD v137
FTVTVPKDLYVVEYGSNMTIECKFPVEKQLDLAALIVYWEMEDKDIIQFVHGEEDLKVQHSSYRQRARLLKDQLSLGNAALQITDVKLQDAGVYRCMISYGGADYKRITVTVNAPYNKINQRILVVDPVTSEHELTCQAEGYPKAEVIWTSSDHQVLSGKTTTTNSKREEKLFNVTSTLRINATTNEVFYCTFRRLDPEENHTAELVIPELPLAHPPNER

SEQ ID NO: 1917 - protein, 220 aa, synthetic construct
  REGION 1..220: note = PD-L1 ECD v138
FTVTVPKDLYVVEYGSNMTIECKFPVEKQLDLAALIVYWEMEDKDIIQFVHGEEDLKVQHSSYRQRARLLKDQLSLGNAALQITDVKLRDAGVYRCMISYGGADYKRITVKVNAPYNKINQRILVVDPVTSEHELTCQAEGYPKAEVIWTSSDHQVLSGKTTTTNSKREEKLFNVTSTLRINTTTNEISYCTFRRLDSEENHTAELVIPELPLAHPPNER

SEQ ID NO: 1918 - protein, 220 aa, synthetic construct
  REGION 1..220: note = PD-L1 ECD v139
FTVTVPKDLYVVEYGSNMTIECKFPVEKQLDLAALIVYWEMEDKDIIQFVHGEEDLKVQHSSYRQRARLLKDQLSLGNAALQITDVKLQDAGVYRCMIGYGGADYKRITVKVNAPYNKINQRILVVDPVTSEHELTRQAEGYPKAEVIWTSSDHQVLSGKTTTTNSKREEKLFNVTSTLRINTTTNEIFYCTFRRLDPEENHTAELAIPELPLAHPPNER

SEQ ID NO: 1919 - protein, 220 aa, synthetic construct
  REGION 1..220: note = PD-L1 ECD v140
FTVTVPKDLYVVEYGSNMTIECKFPVEKQLDLAALIVYWEMEDKDIIQFVHGEEDLKVQHSSYRQRARLLKDQLSLGNAALQITDVKLQDAGVYRCMISYGGADYKRITVKVNAPYNKINQRILVVDPVTSEHELTCQAEGYPKAEVIWTSSDHQVLSGKTTITNSRREEKLFNVTSTLRINTTTNEIFYCTFRGLDPEENHTAELVIPELPLAHPPNER

SEQ ID NO: 1920 - protein, 220 aa, synthetic construct
  REGION 1..220: note = PD-L1 ECD v141
FTVTVPKDLYVVEYGSNMTIECKFPVEKQLDLAALIVYWEMEDKDIIQFVHGEEDLKVQHSSYRQRARLLKDQLSLGNAALQITDVKLQDAGVYRCMISYGGADYKRITVKVNAPYNKINQRILVVDPVTSEHELTCQAEGYPKAEVIWTSSDHQVLSGKTTTTNSKREEKLFNVTSTLRINATTNEIFYCSFGRLDPEENHTAELVIPELPLAHPPNER

SEQ ID NO: 1921 - protein, 220 aa, synthetic construct
  REGION 1..220: note = PD-L1 ECD v142
FTVTVPKDLYVVEYGSNMTIECKFPVEKQLDLAALIVYWEMEDKDIIQFAHGEEDLKVQHSSYRQRARLLKDQLSLGNAALQITDVKLQDAGVYRCMISYGGADYKRITVKVNAPYNKTNQRILVVDPVTSEHELTCQAEGYPEAEVIWTSSDHQVLSGKTTTTNSKREEKLFNVTSTLRINTTTNEIFYCTFRRLDPEENHTAELVIPELPLAHPPNER

SEQ ID NO: 1922 - protein, 220 aa, synthetic construct
  REGION 1..220: note = PD-L1 ECD v143
FTVTVPKDLYVVEYGSNMAIECKFPVEKQLDLAALIVYWEMEDKDIIQFVHGEEDLKVQHSSYRQRARLLKDQLSLGNAALQITDVKLQDAGVYRCMISYGGADYKRITVKVNAPYNKINQRILVVDPVTSEHELTCQAEGYPEAEVIWTSSDHQVLSGKTTTTNSKREEKLFNVTSTLRINTTTNEIFYCTFRGLDPEENHTAELVIPELPLAHPPNER

SEQ ID NO: 1923 - protein, 220 aa, synthetic construct
  REGION 1..220: note = PD-L1 ECD v144
FTVTVPKDLYEVEYGSNMTIECKFPVEKQLDLAALIVYWEMEDKDIIQFVHGEEDLKVQHSSYRQRARLLKDQLSLGNAALQITDVKLQDAGVYRCMISYGGADYKRITVKVNAPYNKINQRILVVDPVASEHELTCQAEGYPKAEVIWTSSDHQVLSGKTTTTNSKREEKLFNVTSTLRINTTTNEIFYCTFRRLDTEENHTAELVIPELPLAHPPNER

SEQ ID NO: 1924 - protein, 220 aa, synthetic construct
  REGION 1..220: note = PD-L1 ECD v145
FTVTVPKDLYVVEYGSNMTIECKFPAEKQLDLAALIVYWEMEDKDIIQFVHGEEDLKVQHSSYRQRARLLKDQLSLGNAALQITDVKLQDAGVYRCMISYGGADYKRITVKVNAPYNKINQRILVVDPVTSEHELTCQAEGYPKAEVIWTSSDHQVLSGKTTITNSKREEKLFNVTSTLRINTTANEIFYCTFRRLDPEENHTAELVIPELPLAHPPNER

SEQ ID NO: 1925 - protein, 220 aa, synthetic construct
  REGION 1..220: note = PD-L1 ECD v146
FTVTVPKDLYVVEYGSNMTIECNFPVEKQLDLAALIVYWEMEDKDIIQFVHGEEDLKVQHSSYRQRARLLKDQLSLGNAALQITDVKLQDAGVYRCMISYGGADYKRITVKVNAPYNKINQRISVVDPVTSEHELTCQAEGYPKAEVIWTSSDHQVLSGKTTTTNSTREEKLFNVTSTLRINTTTNEIFYCTFRGLDPEENHTAELVIPELPLAHPPNER

SEQ ID NO: 1926 - protein, 220 aa, synthetic construct
  REGION 1..220: note = PD-L1 ECD v147
FTVTVPKDLYVVEYGSNMTIECNFPVEKQLDLAALIVYWEMEDKDIIQFVHGEEDLKVQHSSYRQRARLLKDRLSLGNAALQITDVKLQDAGVYRCMISYGGADYKRITVKVNAPYNKINQRILVVDPVTSEHELTCQAEGYPKAEVIWTSSDHQVLSGKTTITNSKREEKLFNVTSTLRINTTTNEIFYCTFRRLDPEENHTAELVIPELPLAHPPNER

SEQ ID NO: 1927 - protein, 220 aa, synthetic construct
  REGION 1..220: note = PD-L1 ECD v148
FTVTVPKDLYVVEYGSNMTIECKFPVEEQLDLAALIVYWEMEDKDIIQFVHGEEDLKVQHSSYRQRARLLKDQLSLGNAALQITDVKLQDAGVYRCMISYGGADYKRITVKVNAPYNKINQRILVVDPVTSEHELTCQAEGYPKAEVIRTSSDHQVLGGKTTTTNSKREEKLFNVTSTLRINTTTNEIFYCTFRRLDTEENHTAELVIPELPLAHPPNER

SEQ ID NO: 1928 - protein, 220 aa, synthetic construct
  REGION 1..220: note = PD-L1 ECD v149
FTVTVPKDLYVVEYGSNMTIECKFPVERQLDLAALIVYWEMEDKDIIQFVHGEEDLEVQHSSYRQRARLLKDQLSLGNAALQITDVKLQDAGVYRCMVSYGGADYKRITVKVNAPYNKINQRILVVDPVTSEHELTCQAEGYPKAEVIWTSSDHQVLSGKTTTTNSKREEKLFNVTSTLRINTTTNEIFYCTFRSLDPEENHTAELVIPELPLAHPPNER

SEQ ID NO: 1929 - protein, 220 aa, synthetic construct
  REGION 1..220: note = PD-L1 ECD v150
FTVTVPKDLYVVEYGSNMTIECKFPVERQLDLAALIVYWEMEDKDIIQFVHGEEDLKVQHSSYRQRARLLKDQLSLGNAALQITDVKLQDAGVYRCMISYGGADYKRITVKVNAPYNKINQRILVVDPDTSEHELTCQAEGYPKAEVIWTSSDHQVLSGKTTNTNSKREEKLFNVTSTLRINTTTNEIFYCTFRTLDPEENHTAELVIPELPLAHPPNER

SEQ ID NO: 1930 - protein, 220 aa, synthetic construct
  REGION 1..220: note = PD-L1 ECD v151
FTVTVPKDLYVVEYGSNMTIECKFPVEKQLDLAALIVYWEKEGKDIIQFVHGEEDLKVQHSSYSQRARLLKDQLSLGNAALQITDVKLQDAGVYRCMISYGGADYKRITVKVNAPYNKINQRILVVDPVTSEHELTCQAEGYPKAEVIWTSSDHQVLSGKTTTTNSKREEKLFNVTSTLRINTTTNEIFYCTFRGLDPEENHTAELVIPELPLAHPPNER

SEQ ID NO: 1931 - protein, 220 aa, synthetic construct
  REGION 1..220: note = PD-L1 ECD v152
FTVTVPKDLYVVEYGSNMTIECKFPVEKQLDLAALIVYWEKEGKDIIQFVHGEEDLKVQHSSYSQRARLLKDQLSLGNAALQITDVKLQDAGVYRCMIGYGGADYKRITVKVNAPYNKINQRILVVDPVTSEHELTCQAEGYPKAEVIWTSSDHQVLSGKTTTTNSKREEKLFNVTSTLRINTTTNEIFYCTFRRLDPEENHTAELVIPELPLAHPPNER

SEQ ID NO: 1932 - protein, 220 aa, synthetic construct
  REGION 1..220: note = PD-L1 ECD v153
FTVTVPKDLYVVEYGSNMTIECKFPVEKQLDLAALIVYWEMEDKDIIQFVHGEEDLKVQHSSYRQRALLLKDQLSLGNAALQITDVKLQDAGVYRCMISYGGADYKRITVKVNAPYNKINQRILVVDPVTSEHELTCQAEGYPKAEVIWTSSDHQVLSGKTTTTNSKREEKLLNVTSTLRINTTTNEIFYCTFRRLGSEENHTAELVIPELPLAHPPNER

SEQ ID NO: 1933 - protein, 220 aa, synthetic construct
  REGION 1..220: note = PD-L1 ECD v154
FTVTVPKDLYVVEYGSNMTIECKFPVEKQLDLAALIVYWEMEDKDIIQFAHGEEDLKVQHSSYRQRARLLKDQLSLGNAALQITDVKLQDAGVYRCMISYGGADYKRITVKVNAPYNKINQRILVVDPVTSEHELTCQAEGYPKAEVVWTSSDHQVLSGKTTTTNSKREEKLFNVTSTLRINTTTNEIFYCTFRGLDPEEDHTAELVIPELPLAHPPNER

SEQ ID NO: 1934 - protein, 220 aa, synthetic construct
  REGION 1..220: note = PD-L1 ECD v155
FTVTVPKDLYVVEYGSNMTIECKFPVEKQLDLAALIVYWEKEGEDIIQFVHGEEDLKVQHSSYRQRARLLKDQLSLGNAALQITDVKLQDAGVYRCMISYGGADYKRITVKVNAPYNKINQRILVVDPVTSEHELTCQAEGYPKAEVIWTSSDHQVLSGKTTTTNSKREEKLFNVTSTLRINTTTNEIFYCTFRGLDPEEDHTAELVIPELPLAHPPNER

SEQ ID NO: 1935 - protein, 220 aa, synthetic construct
  REGION 1..220: note = PD-L1 ECD v156
FTVTVPKDLYVVEYGSNMTIECKFPVEKQLDLAALIVYWEMEDKDIIQFAHGEEDLKVQHSSYRQRARLLKDQLSLGNAALQITDVKLQDAGVYRCMISYGGADYKRITVKVNAPYNKINQRISVVDPVTSEHELTCQAEGYPEAEVIWTSSDHQVLSGKTTTTNSKREEKLFNVTSTPRINTTTNEIFYCTFRGLDPEENHTAELVIPELPLAHPPNER

SEQ ID NO: 1936 - protein, 107 aa, synthetic construct
  REGION 1..107: note = PD-L1 IgV v67
PKDLYVVEYGSNMTIECKFPVEKQLDLAALIVYWEMEDKNIIQFVHGEEDLRVQHSSYRQRARLLKDQLSLGNAALQITDVKLQDAGVYRCMIGYGGADYKRITVKV

SEQ ID NO: 1937 - protein, 107 aa, synthetic construct
  REGION 1..107: note = PD-L1 IgV v75
PKDLYVVEYGSNMTIECKFPVEIQLDLAALIVYWEMEDKNIIQFVHGEEDLKVQHSSYRQRARLLKDQLSLGNAALQITDVKLQDAGVYRCMIGYGGADYKRITVKV

SEQ ID NO: 1938 - protein, 107 aa, synthetic construct
  REGION 1..107: note = PD-L1 IgV v80
PKDLYVVEYGSNMTIECKFPVEKQLDLAALIVYWEMEDKNIIQFVHGEEVLKVQHSSYRQRARLLKDQLSLGNAALQITDVKLQDAGVYRCLIGYGGADYKRITVKV

SEQ ID NO: 1939 - protein, 107 aa, synthetic construct
  REGION 1..107: note = PD-L1 IgV v81
PKDLYVVEYGSNMTIECKFPVGKQLDLAALTVYWEMEDKNIIQFVHGEENLKVQHSSYRQRARLLKDQLSLGNAALQITDVKLQDAGVYRCLISYGGADYKRITVEV

SEQ ID NO: 1940 - protein, 107 aa, synthetic construct
  REGION 1..107: note = PD-L1 IgV v82
PKDLYVVEYGSNMTIECKFPVEKQLDLAALIVYWEMEDKNIIQFVHGEGDLKVQHSSYRQRARLLKDQLSLGNAALQITDVKLQDAGVYRCLIGYGGADYKRITVKV

SEQ ID NO: 1941 - protein, 107 aa, synthetic construct
  REGION 1..107: note = PD-L1 IgV v87
PKDLYVVEYGSNMTIECKFPVEKQLDLAALSVYWEMEDKNIIQFVHGEEDLKVQHSSYRQRARLLKDQLSLGNAALQITDVKLQDAGVYRCLISYGGADYKRITVKV

SEQ ID NO: 1942 - protein, 107 aa, synthetic construct
  REGION 1..107: note = PD-L1 IgV v94
PKDLYVVEYGSNMTIECKFPVEKQLDLAALTVYWEMEDKNIIQFVHGEEDLKVQHSSYRQRARLLKDQLSLGNAALQITDVKLQDAGVYRCLISYGGADYKRITVEV

SEQ ID NO: 1943 - protein, 107 aa, synthetic construct
  REGION 1..107: note = PD-L1 IgV v98
PKDLYVVEYGSNMTIECKFPVEKQLDLAAPSVYWEMEDKNIIQFVHGEEDLKVQHSSYRQRARLLKDQLSLGNAALQITDVKLQDAGVYRCLISYGGADYKRITVEV

SEQ ID NO: 1944 - protein, 107 aa, synthetic construct
  REGION 1..107: note = PD-L1 IgV v100
PKDLYVVEYGSNTTIECKFPVEKQLDLAALTVYWEMEDKNIIQFVHGEENLKVQHSSYRQRARLLKDQLSLGNAALQITDVKLQDAGVYRCLISYGGADYKRITVEV

SEQ ID NO: 1945 - protein, 107 aa, synthetic construct
  REGION 1..107: note = PD-L1 IgV v102
PKDLYVVEYGSNMTIECKFPVEKQLDLAALIVYWEMEDKNIIQFVHGEEDLKVQHSSYRQRARLLKDQLSLGNAALQITDVKLQDAGVYRCLIGYGGADYKRITVKV

SEQ ID NO: 1946 - protein, 107 aa, synthetic construct
  REGION 1..107: note = PD-L1 IgV v103
PKDLYVVEYGSDMTIECKFPVEKQLDLAALIVYWEMEDKNIIQFVHGEEDLKVQHSSYRQRARLLKDQLSLGNAALQITDVKLQDAGVYRCLIGYGGADYKRITVKV

SEQ ID NO: 1947 - protein, 107 aa, synthetic construct
  REGION 1..107: note = PD-L1 IgV v110
PKDLYVVEYGSNMTIECKFPVEKQLDLAALIVYWEMEDKDIIQFVHGEEDLKVQHSSYRQRARLLKDQLSLGNAALQITDVKLQDAGVYRCMISYGGADYKRITVKV

SEQ ID NO: 1948 - protein, 107 aa, synthetic construct
  REGION 1..107: note = PD-L1 IgV v118
PKDLYVVEYGSNMTIECKFPVEKQLDLAALIVYWEMEDKDIIQFVHGEEDLKDQHSSYRQRARLLKDQLSLGNAALQITDVKLQDAGVYRCMISYGGADYKRITVKV

SEQ ID NO: 1949 - protein, 107 aa, synthetic construct
  REGION 1..107: note = PD-L1 IgV v127
PKDLYVVEYGSNMTIECKFPVEKQLDLAALIVYWEMEDKDIIQFVHGEEDLKVQHSSYRQRARLLKDQLSLGNAALQITDVKLRDAGVYRCMVSYGGADYKRITVKV

SEQ ID NO: 1950 - protein, 107 aa, synthetic construct
  REGION 1..107: note = PD-L1 IgV v152
PKDLYVVEYGSNMTIECKFPVEKQLDLAALIVYWEKEGKDIIQFVHGEEDLKVQHSSYSQRARLLKDQLSLGNAALQITDVKLQDAGVYRCMIGYGGADYKRITVKV

SEQ ID NO: 1951 - protein, 114 aa, synthetic construct
  REGION 1..114: note = PD-L1 IgV v67
FTVTVPKDLYVVEYGSNMTIECKFPVEKQLDLAALIVYWEMEDKNIIQFVHGEEDLRVQHSSYRQRARLLKDQLSLGNAALQITDVKLQDAGVYRCMIGYGGADYKRITVKVNA

SEQ ID NO: 1952 - protein, 114 aa, synthetic construct
  REGION 1..114: note = PD-L1 IgV v75
FTVTVPKDLYVVEYGSNMTIECKFPVEIQLDLAALIVYWEMEDKNIIQFVHGEEDLKVQHSSYRQRARLLKDQLSLGNAALQITDVKLQDAGVYRCMIGYGGADYKRITVKVNA

SEQ ID NO: 1953 - protein, 114 aa, synthetic construct
  REGION 1..114: note = PD-L1 IgV v80
FTVTVPKDLYVVEYGSNMTIECKFPVEKQLDLAALIVYWEMEDKNIIQFVHGEEVLKVQHSSYRQRARLLKDQLSLGNAALQITDVKLQDAGVYRCLIGYGGADYKRITVKVNA

SEQ ID NO: 1954 - protein, 114 aa, synthetic construct
  REGION 1..114: note = PD-L1 IgV v81
FTVTVPKDLYVVEYGSNMTIECKFPVGKQLDLAALTVYWEMEDKNIIQFVHGEENLKVQHSSYRQRARLLKDQLSLGNAALQITDVKLQDAGVYRCLISYGGADYKRITVEVNA

SEQ ID NO: 1955 - protein, 114 aa, synthetic construct
  REGION 1..114: note = PD-L1 IgV v82
FTVTVPKDLYVVEYGSNMTIECKFPVEKQLDLAALIVYWEMEDKNIIQFVHGEGDLKVQHSSYRQRARLLKDQLSLGNAALQITDVKLQDAGVYRCLIGYGGADYKRITVKVNA

SEQ ID NO: 1956 - protein, 114 aa, synthetic construct
  REGION 1..114: note = PD-L1 IgV v87
FTVTVPKDLYVVEYGSNMTIECKFPVEKQLDLAALSVYWEMEDKNIIQFVHGEEDLKVQHSSYRQRARLLKDQLSLGNAALQITDVKLQDAGVYRCLISYGGADYKRITVKVNA

SEQ ID NO: 1957 - protein, 114 aa, synthetic construct
  REGION 1..114: note = PD-L1 IgV v94
FTVTVPKDLYVVEYGSNMTIECKFPVEKQLDLAALTVYWEMEDKNIIQFVHGEEDLKVQHSSYRQRARLLKDQLSLGNAALQITDVKLQDAGVYRCLISYGGADYKRITVEVNA

SEQ ID NO: 1958 - protein, 114 aa, synthetic construct
  REGION 1..114: note = PD-L1 IgV v98
FTVTVPKDLYVVEYGSNMTIECKFPVEKQLDLAAPSVYWEMEDKNIIQFVHGEEDLKVQHSSYRQRARLLKDQLSLGNAALQITDVKLQDAGVYRCLISYGGADYKRITVEVNA

SEQ ID NO: 1959 - protein, 114 aa, synthetic construct
  REGION 1..114: note = PD-L1 IgV v100
FTVTVPKDLYVVEYGSNTTIECKFPVEKQLDLAALTVYWEMEDKNIIQFVHGEENLKVQHSSYRQRARLLKDQLSLGNAALQITDVKLQDAGVYRCLISYGGADYKRITVEVNA

SEQ ID NO: 1960 - protein, 114 aa, synthetic construct
  REGION 1..114: note = PD-L1 IgV v102
FTVTVPKDLYVVEYGSNMTIECKFPVEKQLDLAALIVYWEMEDKNIIQFVHGEEDLKVQHSSYRQRARLLKDQLSLGNAALQITDVKLQDAGVYRCLIGYGGADYKRITVKVNA

SEQ ID NO: 1961 - protein, 114 aa, synthetic construct
  REGION 1..114: note = PD-L1 IgV v103
FTVTVPKDLYVVEYGSDMTIECKFPVEKQLDLAALIVYWEMEDKNIIQFVHGEEDLKVQHSSYRQRARLLKDQLSLGNAALQITDVKLQDAGVYRCLIGYGGADYKRITVKVNA

SEQ ID NO: 1962 - protein, 114 aa, synthetic construct
  REGION 1..114: note = PD-L1 IgV v110
FTVTVPKDLYVVEYGSNMTIECKFPVEKQLDLAALIVYWEMEDKDIIQFVHGEEDLKVQHSSYRQRARLLKDQLSLGNAALQITDVKLQDAGVYRCMISYGGADYKRITVKVNA

SEQ ID NO: 1963 - protein, 114 aa, synthetic construct
  REGION 1..114: note = PD-L1 IgV v118
FTVTVPKDLYVVEYGSNMTIECKFPVEKQLDLAALIVYWEMEDKDIIQFVHGEEDLKDQHSSYRQRARLLKDQLSLGNAALQITDVKLQDAGVYRCMISYGGADYKRITVKVNA

SEQ ID NO: 1964 - protein, 114 aa, synthetic construct
  REGION 1..114: note = PD-L1 IgV v127
FTVTVPKDLYVVEYGSNMTIECKFPVEKQLDLAALIVYWEMEDKDIIQFVHGEEDLKVQHSSYRQRARLLKDQLSLGNAALQITDVKLRDAGVYRCMVSYGGADYKRITVKVNA

SEQ ID NO: 1965 - protein, 114 aa, synthetic construct
  REGION 1..114: note = PD-L1 IgV v152
FTVTVPKDLYVVEYGSNMTIECKFPVEKQLDLAALIVYWEKEGKDIIQFVHGEEDLKVQHSSYSQRARLLKDQLSLGNAALQITDVKLQDAGVYRCMIGYGGADYKRITVKVNA

SEQ ID NO: 1966 - protein, 221 aa, synthetic construct
  REGION 1..221: note = PD-L1 ECD v1
FTVTVPKDLYVVEYGSNMTIECKFPVENQLDLAALIVYWEVEDKTIIQFVNGEEDLEVQHSSYRQRARLLKDQLSLGNAALQITDVKLQDAGVYRCMISYGGADYKRITVKVNAPYNKINQRILVVDPVTSEHELTCQAEGYPKAEVIWTSSDHQVLSGKTTTTNSKREEKLFNVTSTLRINTTTNEIFYCTFRRLDPEENHTAELVIPELPLAHPPNERT

SEQ ID NO: 1967 - protein, 221 aa, synthetic construct
  REGION 1..221: note = PD-L1 ECD v2
FTVTVPKDLYVVEYGSNMTLECKFPVEKQLDLAALTVYWEMEDKDITQFVHGEEDLKVQHSSYRQRARLLKDQLSLGNAALQITDVKLQDAGVYRCMISYGGADYKRITVKVNAPYNKINQRILVVDPVTSEHELTCQAEGYPKAEVIWTSSDHQVLSGKTTTTNSKREEKLFNVTSTLRINTTTNEIFYCTFRRLDPEENHTAELVIPELPLAHPPNERT

SEQ ID NO: 1968 - protein, 221 aa, synthetic construct
  REGION 1..221: note = PD-L1 ECD v3
FTVTVPKDLYVVEYGSNMTLECKFPVEKQLDLAALIVYWEKEDENIIQFVHGEEDLKVQHSSYRQRARLLKDQLSLGNAALQITDVKLQDAGVYRCMISYGGADYKRITVKVNAPYNKINQRILVVDPVTSEHELTCQAEGYPKAEVIWTSSDHQVLSGKTTTTNSKREEKLFNVTSTLRINTTTNEIFYCTFRRLDPEENHTAELVIPELPLAHPPNERT

SEQ ID NO: 1969 - protein, 221 aa, synthetic construct
  REGION 1..221: note = PD-L1 ECD v4
FTVTVSKDLYVVEYGSNMTIECKFPVEKQLDLAALIVYWEMEDKTIIQFVHGEEDLKVQHSSYRQRARLLKDQLSLGIAALQTTDVKLQDAGVYRCMISYGGADYKRITVKVNAPYNKINQRILVVDPVTSEHELTCQAEGYPKAEVIWTSSDHQVLSGKTTTTNSKREEKLFNVTSTLRINTTTNEIFYCTFRRLDPEENHTAELVIPELPLAHPPNERT

SEQ ID NO: 1970 - protein, 221 aa, synthetic construct
  REGION 1..221: note = PD-L1 ECD v5
FTVTVPKDLYVVEYGSNMTIECKFPVEKQLDLAALIVYWEMEDKNIIQFVHGEEDLKVQHSSYRQRARLLKDQLSLGIAALQITDVKLQDAGVYRCMISYGGADYKRITVKVNAPYNKINQRILVVDPVTSEHELTCQAEGYPKAEVIWTSSDHQVLSGKTTTTNSKREEKLFNVTSTLRINTTTNEIFYCTFRRLDPEENHTAELVIPELPLAHPPNERT

SEQ ID NO: 1971 - protein, 221 aa, synthetic construct
  REGION 1..221: note = PD-L1 ECD v6
FTVTVPKDLYVVEYGSNMTIECKFPVEKQLDLAALIVYWEKEDKNIIQFVHGEEDLKVQHSSYRQRARLLKDQLSLGIAALQITDVKLQDAGVYRCMISYGGADYKRITVKVNAPYNKINQRILVVDPVTSEHELTCQAEGYPKAEVIWTSSDHQVLSGKTTTTNSKREEKLFNVTSTLRINTTTNEIFYCTFRRLDPEENHTAELVIPELPLAHPPNERT

SEQ ID NO: 1972 - protein, 221 aa, synthetic construct
  REGION 1..221: note = PD-L1 ECD v7
FTVTVPKDLYVVEYGSNMTIECKFPVEKQLDLAALIVYWEMEDKTIIQFVHGEEDLKVQHSSYRQRARLLKDQLSLGIAALQITDVKLQDAGVYRCMISYGGADYKRITVKVNAPYNKINQRILVVDPVTSEHELTCQAEGYPKAEVIWTSSDHQVLSGKTTTTNSKREEKLFNVTSTLRINTTTNEIFYCTFRRLDPEENHTAELVIPELPLAHPPNERT

SEQ ID NO: 1973 - protein, 221 aa, synthetic construct
  REGION 1..221: note = PD-L1 ECD v8
FTVTVPKDLYVVEYGSNMTLECKFPVEKQLDLAALIVYWEMEDKTIIQFVHGEEDLKVQHSSYRQRARLLKDQLSLGNAALQITDVKLQDAGVYRCMISYGGADYKRITVKVNAPYNKINQRILVVDPVTSEHELTCQAEGYPKAEVIWTSSDHQVLSGKTTTTNSKREEKLFNVTSTLRINTTTNEIFYCTFRRLDPEENHTAELVIPELPLAHPPNERT

SEQ ID NO: 1974 - protein, 221 aa, synthetic construct
  REGION 1..221: note = PD-L1 ECD v9
FTVTVPKDLYVVEYGSNMTIECKFPVEKQLDLAALIVYWEMEDKTIIQFVHGEEDLKVQHSSYRQRARLLKDQLSLGNAALQITDVKLQDAGVYRCMISYGGADYKRITVKVNAPYNKINQRILVVDPVTSEHELTCQAEGYPKAEVIWTSSDHQVLSGKTTTTNSKREEKLFNVTSTLRINTTTNEIFYCTFRRLDPEENHTAELVIPELPLAHPPNERT

SEQ ID NO: 1975 - protein, 221 aa, synthetic construct
  REGION 1..221: note = PD-L1 ECD v10
FTVTVPKDLYVVEYGSNMTIECKFPVEKQLDLAALIVYWEKEDKNIIQFVHGEEDLKVQHSSYRQRARLLKDQLSLGNAALQITDVKLQDAGVYRCMISYGGADYKRITVKVNAPYNKINQRILVVDPVTSEHELTCQAEGYPKAEVIWTSSDHQVLSGKTTTTNSKREEKLFNVTSTLRINTTTNEIFYCTFRRLDPEENHTAELVIPELPLAHPPNERT

SEQ ID NO: 1976 - protein, 221 aa, synthetic construct
  REGION 1..221: note = PD-L1 ECD v11
FTVTVPKDLYVVEYGSNMTLECKFPVEKQLDLAALTVYWEMEDKDIIQFVHGEEDLKVQHSSYRQRARLLKDQLSLGNAALQITDVKLQDAGVYRCMISYGGADYKRITVKVNAPYNKINQRILVVDPVTSEHELTCQAEGYPKAEVIWTSSDHQVLSGKTTTTNSKREEKLFNVTSTLRINTTTNEIFYCTFRRLDPEENHTAELVIPELPLAHPPNERT

SEQ ID NO: 1977 - protein, 221 aa, synthetic construct
  REGION 1..221: note = PD-L1 ECD v12
FTVTVPKDLYVVEYGSDMTIECKFPVEKQLDLAALIVYWEMEDKTIIQFAHGEEDLKVQHSSYRQRARLLKGQLSLGNAALQITDVKLQDAGVYRCMISYGGADYKRITVKVNAPYNKINQRILVVDPVTSEHELTCQAEGYPKAEVIWTSSDHQVLSGKTTTTNSKREEKLFNVTSTLRINTTTNEIFYCTFRRLDPEENHTAELVIPELPLAHPPNERT

SEQ ID NO: 1978 - protein, 221 aa, synthetic construct
  REGION 1..221: note = PD-L1 ECD v13
FTVTVPKDLYVVEYGSNMTLECKFPVEKQLDLAALIVYWEMEDKNIIQSVHGEEDLKVQHSSYRQRARLLKDQLSLGNAALQITDVKLQDAGVYRCMISYGGADYKRITVKVNAPYNKINQRILVVDPVTSEHELTCQAEGYPKAEVIWTSSDHQVLSGKTTTTNSKREEKLFNVTSTLRINTTTNEIFYCTFRRLDPEENHTAELVIPELPLAHPPNERT

SEQ ID NO: 1979 - protein, 221 aa, synthetic construct
  REGION 1..221: note = PD-L1 ECD v14
FTVTVPKDLYVVEYGSNMTIECKFPVEKQLDLAALIVYWEMEDKTIIQFAHGEEDLKVQHSSYRQRARLLKDQLSLGNAALQITDVKLQDAGVYRCMISYGGADYKRITVKVNAPYNKINQRILVVDPVTSEHELTCQAEGYPKAEVIWTSSDHQVLSGKTTTTNSKREEKLFNVTSTLRINTTTNEIFYCTFRRLDPEENHTAELVIPELPLAHPPNERT

SEQ ID NO: 1980 - protein, 221 aa, synthetic construct
  REGION 1..221: note = PD-L1 ECD v15
FTVTVPKDLYVVEYGSNMTLECKFPVEKQLDLAALIVYWEMEDKTIIQFVHGEEDLKVQHSSYRQRARLLKDQLSLGIAALQITDVKLQDAGVYRCMISYGGADYKRITVKVNAPYNKINQRILVVDPVTSEHELTCQAEGYPKAEVIWTSSDHQVLSGKTTTTNSKREEKLFNVTSTLRINTTTNEIFYCTFRRLDPEENHTAELVIPELPLAHPPNERT

SEQ ID NO: 1981 - protein, 221 aa, synthetic construct
  REGION 1..221: note = PD-L1 ECD v16
FTVTVPKDLYVVEYGSNMTLECKFPVEKQLDLAALIVYWEMEDKTIIQFAHGEEDLKVQHSSYRQRARLLKDQLSLGNAALQITDVKLQDAGVYRCMISYGGADYKRITVKVNAPYNKINQRILVVDPVTSEHELTCQAEGYPKAEVIWTSSDHQVLSGKTTTTNSKREEKLFNVTSTLRINTTTNEIFYCTFRRLDPEENHTAELVIPELPLAHPPNERT

SEQ ID NO: 1982 - protein, 221 aa, synthetic construct
  REGION 1..221: note = PD-L1 ECD v17
FTVTVPKDLYVVEYGSNMTIECKFPVEKQLDLAALIVYWEVEDKTIIQFVHGEEDLKVQHSSYRQRARLLKDQLSLGNAALQITDVKLQDAGVYRCMISYGGADYKRITVKVNAPYNKINQRILVVDPVTSEHELTCQAEGYPKAEVIWTSSDHQVLSGKTTTTNSKREEKLFNVTSTLRINTTTNEIFYCTFRRLDPEENHTAELVIPELPLAHPPNERT

SEQ ID NO: 1983 - protein, 221 aa, synthetic construct
  REGION 1..221: note = PD-L1 ECD v18
FTVTVPKDLYVVEYGSNMTIECKFPVEKQLDLAALIVYWEKEDKTIIQFVHGEEDLKVQHSSYRQRARLLKDQLSLGNAALQITDVKLQDAGVYRCMISYGGADYKRITVKVNAPYNKINQRILVVDPVTSEHELTCQAEGYPKAEVIWTSSDHQVLSGKTTTTNSKREEKLFNVTSTLRINTTTNEIFYCTFRRLDPEENHTAELVIPELPLAHPPNERT

SEQ ID NO: 1984 - protein, 221 aa, synthetic construct
  REGION 1..221: note = PD-L1 ECD v19
FTVTVPKDLYVVEYGSNMTIECKFPVEKQLDLDALIVYWEMEDKNIIQFVHGEEDLKVQHSSYRQRARLLKDQLPLGNAALQITEVKLQDAGVYRCMISYGGADYKRITVKVNAPYNKINQRILVVDPVTSEHELTCQAEGYPKAEVIWTSSDHQVLSGKTTTTNSKREEKLFNVTSTLRINTTTNEIFYCTFRRLDPEENHTAELVIPELPLAHPPNERT

SEQ ID NO: 1985 - protein, 221 aa, synthetic construct
  REGION 1..221: note = PD-L1 ECD v20
FTVTVPKDLYVVEYGSNITIECKFPVEKQLDLAALIVYWEKEGKNIIQFVRGEEDLKVQHSSYRQRARLLKDQLSLGIAALQITDVKLQDAGVYRCMISYGGADYKRITVKVNAPYNKINQRILVVDPVTSEHELTCQAEGYPKAEVIWTSSDHQVLSGKTTTTNSKREEKLFNVTSTLRINTTTNEIFYCTFRRLDPEENHTAELVIPELPLAHPPNERT

SEQ ID NO: 1986 - protein, 221 aa, synthetic construct
  REGION 1..221: note = PD-L1 ECD v21
FTVTVPKDLYEVEYGSNMTLECKFPVEKQLDLAALTVYWEMEDKDIIQFVHGEEDLKVQRSSYRQRARLLKDQLPLGNAALQITDVKLQDAGVYRCMISYGGADYKRITVKVNAPYNKINQRILVVDPVTSEHELTCQAEGYPKAEVIWTSSDHQVLSGKTTTTNSKREEKLFNVTSTLRINTTTNEIFYCTFRRLDPEENHTAELVIPELPLAHPPNERT

SEQ ID NO: 1987 - protein, 221 aa, synthetic construct
  REGION 1..221: note = PD-L1 ECD v22
FTVTVPKDLYVVEYGSNMTIECKFPVEKQLDLDALIVYWEMEDKNIIQFAHGEEDLKVQHSSYRQRARLLKDQLSLGNAALQITDVKLQDAGVYRCMISYGGADYKRITVKVNAPYNKINQRILVVDPVTSEHELTCQAEGYPKAEVIWTSSDHQVLSGKTTTTNSKREEKLFNVTSTLRINTTTNEIFYCTFRRLDPEENHTAELVIPELPLAHPPNERT

SEQ ID NO: 1988 - protein, 221 aa, synthetic construct
  REGION 1..221: note = PD-L1 ECD v23
FTVTVPKDLYVVEYGGNMTIECKFPVEKQLDLDALIVYWEMEDKNIIQFVHGEEDLKVQHSSYRQRARLLEDQLPLGNAALQITDVKLQDAGVYRCMISYGGADYKRITVKVNAPYNKINQRILVVDPVTSEHELTCQAEGYPKAEVIWTSSDHQVLSGKTTTTNSKREEKLFNVTSTLRINTTTNEIFYCTFRRLDPEENHTAELVIPELPLAHPPNERT

SEQ ID NO: 1989 - protein, 221 aa, synthetic construct
  REGION 1..221: note = PD-L1 ECD v24
FTVTVPKDLYVVEYGSNMTIECKFPVGKQLDLAALIVYWEMEDKTIIQFVHGEEDLKVQHSSYRQRARLLKDQLSLGNAALQITDVKLQDAGVYRCIISYGGADYKRITVKVNAPYNKINQRILVVDPVTSEHELTCQAEGYPKAEVIWTSSDHQVLSGKTTTTNSKREEKLFNVTSTLRINTTTNEIFYCTFRRLDPEENHTAELVIPELPLAHPPNERT

SEQ ID NO: 1990 - protein, 221 aa, synthetic construct
  REGION 1..221: note = PD-L1 ECD v25
FTVTVPKDLYVVEYGSNMTIECKFPVGKQLDLAALIVYWEMEDKTIIQFVHGEEDLRVQHSSYRQRARLLKDQLSLGNAALQITDVKLQDAGVYRCMISYGGADYKRITVKVNAPYNKINQRILVVDPVTSEHELTCQAEGYPKAEVIWTSSDHQVLSGKTTTTNSKREEKLFNVTSTLRINTTTNEIFYCTFRRLDPEENHTAELVIPELPLAHPPNERT

SEQ ID NO: 1991 - protein, 221 aa, synthetic construct
  REGION 1..221: note = PD-L1 ECD v26
FTVTVPKDLYVVEYGSNMTIECKFPVEKQLDLDALIVYWEMEDKNIIQFVHGVEDLKVQHSSYRQRARLLKDQLSLGNAALQITDVKLQDAGVYRCMISYGGADYKRITVKVNAPYNKINQRILVVDPVTSEHELTCQAEGYPKAEVIWTSSDHQVLSGKTTTTNSKREEKLFNVTSTLRINTTTNEIFYCTFRRLDPEENHTAELVIPELPLAHPPNERT

SEQ ID NO: 1992 - protein, 221 aa, synthetic construct
  REGION 1..221: note = PD-L1 ECD v27
FTVTVPKDLYVVEYGSNMTIECKFPVEKQLDLAALIVYWEMEGKDIIQFVHGEEDLKAQHSSYRQRARLLKDQLSLGNAALQITDVKLQDAGVYRCMISYGGADYKRITVKVNAPYNKINQRILVVDPVTSEHELTCQAEGYPKAEVIWTSSDHQVLSGKTTTTNSKREEKLFNVTSTLRINTTTNEIFYCTFRRLDPEENHTAELVIPELPLAHPPNERT

SEQ ID NO: 1993 - protein, 221 aa, synthetic construct
  REGION 1..221: note = PD-L1 ECD v28
FTVTVPKDLYVVEYGSNMTIECKFPVEKQLDLAALIVYWGMEVKTIIQFAHGEEDLKVQHSSYRQRARLLKDQLSLGNAALQITDVKLQDAGVYRCMISYGGADYKRITVKVNAPYNKINQRILVVDPVTSEHELTCQAEGYPKAEVIWTSSDHQVLSGKTTTTNSKREEKLFNVTSTLRINTTTNEIFYCTFRRLDPEENHTAELVIPELPLAHPPNERT

SEQ ID NO: 1994 - protein, 221 aa, synthetic construct
  REGION 1..221: note = PD-L1 ECD v29
FTVTVPKDLYVVESGSNMTIECKFPVEEQLDLAALIVYWEMEDKTIIQFVHGEEDLKVQHSSYRQRARLLKDQLSLGNAALQITDVKLQDAGVYRCMISYGGADYKRITVKVNAPYNKINQRILVVDPVTSEHELTCQAEGYPKAEVIWTSSDHQVLSGKTTTTNSKREEKLFNVTSTLRINTTTNEIFYCTFRRLDPEENHTAELVIPELPLAHPPNERT

SEQ ID NO: 1995 - protein, 221 aa, synthetic construct
  REGION 1..221: note = PD-L1 ECD v30
FTVTVPKDLYVVEYGSNMTIECKFPVEKQLDLDALIVYWEMEDKNIIQFVHGEEDLKVQHSSYRQRARLLKDQLSLGSAALQITDVKLQDAGVYRCMISYGGADYKRITVKVNAPYNKINQRILVVDPVTSEHELTCQAEGYPKAEVIWTSSDHQVLSGKTTTTNSKREEKLFNVTSTLRINTTTNEIFYCTFRRLDPEENHTAELVIPELPLAHPPNERT

SEQ ID NO: 1996 - protein, 221 aa, synthetic construct
  REGION 1..221: note = PD-L1 ECD v31
FTVTVPKDLYVVEYGSNMTIECKFPVEKQLDLDALIVYWEMEDKNIIQFVHGEEDLKVQHSSYRQRARLLKDQLSLGIAALQITDVKLQDAGVYRCMISYGGADYKRITVKVNAPYNKINQRILVVDPVTSEHELTCQAEGYPKAEVIWTSSDHQVLSGKTTTTNSKREEKLFNVTSTLRINTTTNEIFYCTFRRLDPEENHTAELVIPELPLAHPPNERT

SEQ ID NO: 1997 - protein, 221 aa, synthetic construct
  REGION 1..221: note = PD-L1 ECD v32
FTVTVPKDLYVVEYGSNMTIECKFPVEKQLDLDALIVYWEMEDKTIIQFVHGEEDLKVQHSSYRQRARLLKDQLSLGNAALQITDVKLQDAGVYRCMISYGGADYKRITVKVNAPYNKINQRILVVDPVTSEHELTCQAEGYPKAEVIWTSSDHQVLSGKTTTTNSKREEKLFNVTSTLRINTTTNEIFYCTFRRLDPEENHTAELVIPELPLAHPPNERT

SEQ ID NO: 1998 - protein, 221 aa, synthetic construct
  REGION 1..221: note = PD-L1 ECD v33
FTVTVPKDLYVVEYGSNMTIECKFPVEKQLDLDALIVYWEMEDKTIIQFVHGEEDLKVQHSSYRQRARLLKDQLSLGIAALQITDVKLQDAGVYRCMISYGGADYKRITVKVNAPYNKINQRILVVDPVTSEHELTCQAEGYPKAEVIWTSSDHQVLSGKTTTTNSKREEKLFNVTSTLRINTTTNEIFYCTFRRLDPEENHTAELVIPELPLAHPPNERT

SEQ ID NO: 1999 - protein, 221 aa, synthetic construct
  REGION 1..221: note = PD-L1 ECD v34
FTVTVPKDLYVVEYGSNMTIECKFPVGKQLDLAALIVYWEMEDKTIIQFAHGEEDLKVQHSSYRQRARLLKDQLSLGNAALQITDVKLQDAGVYRCMISYGGADYKRITVKVNAPYNKINQRILVVDPVTSEHELTCQAEGYPKAEVIWTSSDHQVLSGKTTTTNSKREEKLFNVTSTLRINTTTNEIFYCTFRRLDPEENHTAELVIPELPLAHPPNERT

SEQ ID NO: 2000 - protein, 221 aa, synthetic construct
  REGION 1..221: note = PD-L1 ECD v35
FTVTVPKDLYVVEYGSNMTIECKFPVEKQLDLAALIVYWEMEDKTIIQFAHGEEDLKVQHSSYRQRARLLKDQLSLGSAALQITDVKLQDAGVYRCMISYGGADYKRITVKVNAPYNKINQRILVVDPVTSEHELTCQAEGYPKAEVIWTSSDHQVLSGKTTTTNSKREEKLFNVTSTLRINTTTNEIFYCTFRRLDPEENHTAELVIPELPLAHPPNERT

SEQ ID NO: 2001 - protein, 221 aa, synthetic construct
  REGION 1..221: note = PD-L1 ECD v36
FTVTVPKDLYVVEYGSNMTLECKFPVEKQLDLAALIVYWEMEDKTIIQFVHGEEDLKVQHSSYRQRARLLKDQLSLGNAALQITDVKLQDAGVYRCMISYGGADYKRITMKVNAPYNKINQRILVVDPVTSEHELTCQAEGYPKAEVIWTSSDHQVLSGKTTTTNSKREEKLFNVTSTLRINTTTNEIFYCTFRRLDPEENHTAELVIPELPLAHPPNERT

SEQ ID NO: 2002 - protein, 221 aa, synthetic construct
  REGION 1..221: note = PD-L1 ECD v37
FTVTVPKDLYVVEYGSNMTLECKFPVEKQLDLAALTVYWEMEDKTIIQFAHGEEDLKVQHSSYRQRARLLKDQLSLGNAALQITDVKLQDAGVYRCMISYGGADYKRITVKVNAPYNKINQRILVVDPVTSEHELTCQAEGYPKAEVIWTSSDHQVLSGKTTTTNSKREEKLFNVTSTLRINTTTNEIFYCTFRRLDPEENHTAELVIPELPLAHPPNERT

SEQ ID NO: 2003 - protein, 221 aa, synthetic construct
  REGION 1..221: note = PD-L1 ECD v38
FTVTVPKDLYVVEYGSNMTIECKFPVEKQLDLAALIVYWEMEDKTIIQFVHGEEDLKVQHSSYRQRARLLKDQPPLGNAALQITDVKLQDAGVYRCMISYGGADYKRITVKVNAPYNKINQRILVVDPVTSEHELTCQAEGYPKAEVIWTSSDHQVLSGKTTTTNSKREEKLFNVTSTLRINTTTNEIFYCTFRRLDPEENHTAELVIPELPLAHPPNERT

SEQ ID NO: 2004 - protein, 221 aa, synthetic construct
  REGION 1..221: note = PD-L1 ECD v39
FTVTVPKDLYVVEYGSNMTIECKFPVEKQLDLAALIVYWEMEDKTIIQFVHGEEDLKVQHSSYRQRARLLKDQLPLGNAALQITDVKLQDAGVYRCMISYGGADYKRITVKVNAPYNKINQRILVVDPVTSEHELTCQAEGYPKAEVIWTSSDHQVLSGKTTTTNSKREEKLFNVTSTLRINTTTNEIFYCTFRRLDPEENHTAELVIPELPLAHPPNERT

SEQ ID NO: 2005 - protein, 221 aa, synthetic construct
  REGION 1..221: note = PD-L1 ECD v40
FTVTVPKDLYVVEYGSNMTIECKFPVEKQLDLAALIVYWEMEDKNIIQFVHGEEDLKVQHSSYRQRARLLKDQLPLGNAALQITDVKLQDAGVYRCMISYGGADYRRITVKVNAPYNKINQRILVVDPVTSEHELTCQAEGYPKAEVIWTSSDHQVLSGKTTTTNSKREEKLFNVTSTLRINTTTNEIFYCTFRRLDPEENHTAELVIPELPLAHPPNERT

SEQ ID NO: 2006 - protein, 221 aa, synthetic construct
  REGION 1..221: note = PD-L1 ECD v41
FTVTVPKDLYVVEYGSNMTIECKFPVEKQLDLAALIVYWEMEDKNIIQFVHGEEDLKVQHSSYRQRARLLKDQLPLGNAALQITDVKLQDAGVYRCMISYGGADYKRITVKVNAPYNKINQRILVVDPVTSEHELTCQAEGYPKAEVIWTSSDHQVLSGKTTTTNSKREEKLFNVTSTLRINTTTNEIFYCTFRRLDPEENHTAELVIPELPLAHPPNERT

SEQ ID NO: 2007 - protein, 221 aa, synthetic construct
  REGION 1..221: note = PD-L1 ECD v42
FTVTVPKDLYVVEYGSNMTIECKFPVEKQLDLDALIVYWEMEDKNIIQFVHGEEDLKVQHSSYRQRARLLKDQLPLGNAALQITDVKLQDAGVYRCVISYGGADYKRITVKVNAPYNKINQRILVVDPVTSEHELTCQAEGYPKAEVIWTSSDHQVLSGKTTTTNSKREEKLFNVTSTLRINTTTNEIFYCTFRRLDPEENHTAELVIPELPLAHPPNERT

SEQ ID NO: 2008 - protein, 221 aa, synthetic construct
  REGION 1..221: note = PD-L1 ECD v43
FTVTVPKDLYVVEYGSNMTIECKFPVEKQLDLDALIVYWEMEDKNIIQFVHGEEDLKVQHSSYRQRARLLKDQLPLGNAALQITDVKLQDAGVYRCMISYGGAGYKRITVKVNAPYNKINQRILVVDPVTSEHELTCQAEGYPKAEVIWTSSDHQVLSGKTTTTNSKREEKLFNVTSTLRINTTTNEIFYCTFRRLDPEENHTAELVIPELPLAHPPNERT

SEQ ID NO: 2009 - protein, 221 aa, synthetic construct
  REGION 1..221: note = PD-L1 ECD v44
FTVTVPKDLYVVEYGSNMTIECKFPVEKQLDLDALIVYWEMEDKNIIQFVHGEEDLKVQHSSYRQRARLLKDQLPLGNAALQITDVKLQDAGVYRCMISYGGADYKRITVKVNAPYNKINQRILVVDPVTSEHELTCQAEGYPKAEVIWTSSDHQVLSGKTTTTNSKREEKLFNVTSTLRINTTTNEIFYCTFRRLDPEENHTAELVIPELPLAHPPNERT

SEQ ID NO: 2010 - protein, 221 aa, synthetic construct
  REGION 1..221: note = PD-L1 ECD v45
FTVTVPKDLYVVEYGSNMTLECKFPVGKQLDLAALIVYWEMEDKTIIQFAHGEEDLKVQHSSYRQRARLLKDQLSLGNAALQITDVKLQDAGVYRCMISYGGADYKRITVKVNAPYNKINQRILVVDPVTSEHELTCQAEGYPKAEVIWTSSDHQVLSGKTTTTNSKREEKLFNVTSTLRINTTTNEIFYCTFRRLDPEENHTAELVIPELPLAHPPNERT

SEQ ID NO: 2011 - protein, 221 aa, synthetic construct
  REGION 1..221: note = PD-L1 ECD v46
FTVTVPKDLYVVEYGSNMTLECKFPVGKQLDLAALIVYWEMEGKDIIQFVHGEEDLKAQHSSYRQRARLLKDQLSLGIAALQITDVKLQDAGVYRCMISYGGADYKRITVKVNAPYNKINQRILVVDPVTSEHELTCQAEGYPKAEVIWTSSDHQVLSGKTTTTNSKREEKLFNVTSTLRINTTTNEIFYCTFRRLDPEENHTAELVIPELPLAHPPNERT

SEQ ID NO: 2012 - protein, 221 aa, synthetic construct
  REGION 1..221: note = PD-L1 ECD v47
FTVTVPKDLYVVEYGSNMTLECKFPVEKQLDLAALIVYWEMEGKDIIQFVHGEEDLKAQHSSYRQRARLLKDQLSLGIAALQITDVKLQDAGVYRCMISYGGADYKRITVKVNAPYNKINQRILVVDPVTSEHELTCQAEGYPKAEVIWTSSDHQVLSGKTTTTNSKREEKLFNVTSTLRINTTTNEIFYCTFRRLDPEENHTAELVIPELPLAHPPNERT

SEQ ID NO: 2013 - protein, 221 aa, synthetic construct
  REGION 1..221: note = PD-L1 ECD v48
FTVTVPKDLYVVEYGSNMTLECKFPVEKQLDLDALIVYWEMEGKDIIQFVHGEEDLKAQHSSYRQRARLLKDQLSLGIAALQITDVKLQDAGVYRCMISYGGADYKRITVKVNAPYNKINQRILVVDPVTSEHELTCQAEGYPKAEVIWTSSDHQVLSGKTTTTNSKREEKLFNVTSTLRINTTTNEIFYCTFRRLDPEENHTAELVIPELPLAHPPNERT

SEQ ID NO: 2014 - protein, 221 aa, synthetic construct
  REGION 1..221: note = PD-L1 ECD v49
FTVTVPKDLYVVEYGSNMTLECKFPVEKQLDLAALIVYWEMEGKDIIQFVHGEEDLKVQHSSYRQRARLLKDQLSLGIAALQITDVKLQDAGVYRCMISYGGADYKRITVKVNAPYNKINQRILVVDPVTSEHELTCQAEGYPKAEVIWTSSDHQVLSGKTTTTNSKREEKLFNVTSTLRINTTTNEIFYCTFRRLDPEENHTAELVIPELPLAHPPNERT

SEQ ID NO: 2015 - protein, 221 aa, synthetic construct
  REGION 1..221: note = PD-L1 ECD v50
FTVTVPKDLYVVEYGSNMTIECKFPVGKQLDLAALIVYWEMEDKTIIQFAHGEEDLKVQHSSYRQRARLLKDQLSLGIAALQITDVKLQDAGVYRCMISYGGADYKRITVKVNAPYNKINQRILVVDPVTSEHELTCQAEGYPKAEVIWTSSDHQVLSGKTTTTNSKREEKLFNVTSTLRINTTTNEIFYCTFRRLDPEENHTAELVIPELPLAHPPNERT

SEQ ID NO: 2016 - protein, 221 aa, synthetic construct
  REGION 1..221: note = PD-L1 ECD v51
FTVTVPKDLYVVEYGSNMTIECKFPVEKQLDLAALIVYWEMEDKTIIQFAHGEEDLKVQHSSYRQRARLLKDQLSLGIAALQITDVKLQDAGVYRCMISYGGADYKRITVKVNAPYNKINQRILVVDPVTSEHELTCQAEGYPKAEVIWTSSDHQVLSGKTTTTNSKREEKLFNVTSTLRINTTTNEIFYCTFRRLDPEENHTAELVIPELPLAHPPNERT

SEQ ID NO: 2017 - protein, 221 aa, synthetic construct
  REGION 1..221: note = PD-L1 ECD v52
FTVTVPKDLYAVEYGSNMTLECKFPVGKQLDLAALIVYWEMEGKDIIQFVYGEEDLKVQHSSYRQRARLLKDQLSLGNAALQITDVKLQDAGVYRCMIGYGGADYKRITVKVNAPYNKINQRILVVDPVTSEHELTCQAEGYPKAEVIWTSSDHQVLSGKTTTTNSKREEKLFNVTSTLRINTTTNEIFYCTFRRLDPEENHTAELVIPELPLAHPPNERT

SEQ ID NO: 2018 - protein, 221 aa, synthetic construct
  REGION 1..221: note = PD-L1 ECD v53
FTVTVPKDLYVVEYGSNMTLECKFPVGKQLDLAALIVYWEMEGKTIIQFAHGEEDLKVQHSSYRQRARLLKDQLSLGNAALQITDVKLQDAGVYRCMISYGGADYKRITVKVNAPYNKINQRILVVDPVTSEHELTCQAEGYPKAEVIWTSSDHQVLSGKTTTTNSKREEKLFNVTSTLRINTTTNEIFYCTFRRLDPEENHTAELVIPELPLAHPPNERT

SEQ ID NO: 2019 - protein, 221 aa, synthetic construct
  REGION 1..221: note = PD-L1 ECD v54
FTVTVPKDLYVVEYGSNMTLECKFPVEEQLDLAALIVYWEMEGKDIIQFVHGEEDLKAQHSSYRQRARLLKDQLSLGNAALQITDVKLRDAGVYRCMISYGGADYKRITVKVNAPYNKINQRILVVDPVTSEHELTCQAEGYPKAEVIWTSSDHQVLSGKTTTTNSKREEKLFNVTSTLRINTTTNEIFYCTFRRLDPEENHTAELVIPELPLAHPPNERT

SEQ ID NO: 2020 - protein, 221 aa, synthetic construct; identical to SEQ ID NO: 1976
  REGION 1..221: note = PD-L1 ECD v55

SEQ ID NO: 2021 - protein, 221 aa, synthetic construct
  REGION 1..221: note = PD-L1 ECD v56
FTVTVPKDLYVVEYGSNMTLECKFPVEEQLDLAALIVYWEMEGKDIIQFVHGGEDLKAQHSSYRQRARLLKDQLSLGIAALQITDVKLQDAGVYRCMISYGGADYKRITVKVNAPYNKINQRILVVDPVTSEHELTCQAEGYPKAEVIWTSSDHQVLSGKTTTTNSKREEKLFNVTSTLRINTTTNEIFYCTFRRLDPEENHTAELVIPELPLAHPPNERT

SEQ ID NO: 2022 - protein, 221 aa, synthetic construct
  REGION 1..221: note = PD-L1 ECD v57
FTVTVPKDLYVVEYGSNMTIECKFPVEKQLDLDALIVYWEMEGKDIIQFVHGEEDLKAQHSSYRQRARLLKDQLPLGNAALQITDVKLQDAGVYRCMISYGGADYKRITVKVNAPYNKINQRILVVDPVTSEHELTCQAEGYPKAEVIWTSSDHQVLSGKTTTTNSKREEKLFNVTSTLRINTTTNEIFYCTFRRLDPEENHTAELVIPELPLAHPPNERT

SEQ ID NO: 2023 - protein, 221 aa, synthetic construct
  REGION 1..221: note = PD-L1 ECD v58
FTVTVPKDLYVVEYGSNMTIECRFPVEKQLDLAALIVYWEMEGKDIIQFVHGEEDLKVQHSSYRQRARLLKDQLSLGNAALQITDVKLQDAGVYRCMISYGGADYKRITVKVNAPYNKINQRILVVDPVTSEHELTCQAEGYPKAEVIWTSSDHQVLSGKTTTTNSKREEKLFNVTSTLRINTTTNEIFYCTFRRLDPEENHTAELVIPELPLAHPPNERT

SEQ ID NO: 2024 - protein, 221 aa, synthetic construct
  REGION 1..221: note = PD-L1 ECD v59
FTVTVPKDLYVVEYGSNMTLECKFPVEKQLDLAALIVYWEMEGKDIIQFVHGEEDLKAQHSSYRQRARLLKDQLSLGIAALQITDVKLQGAGVYRCMISYDGADYKRITVKVNAPYNKINQRILVVDPVTSEHELTCQAEGYPKAEVIWTSSDHQVLSGKTTTTNSKREEKLFNVTSTLRINTTTNEIFYCTFRRLDPEENHTAELVIPELPLAHPPNERT

SEQ ID NO: 2025 - protein, 222 aa, synthetic construct
  REGION 1..222: note = PD-L1 ECD v60
FTVTVPKDLYVVEYGSNMTIECKFPVEKQLDLAALIVYWEMEGKDIIQFVHGEEDQKAQHSSYRQRARLLKDQLSLGNAALQITDVKLQDAGVYRCMISYGGGADYKRITVKVNAPYNKINQRILVVDPVTSEHELTCQAEGYPKAEVIWTSSDHQVLSGKTTTTNSKREEKLFNVTSTLRINTTTNEIFYCTFRRLDPEENHTAELVIPELPLAHPPNERT

SEQ ID NO: 2026 - protein, 221 aa, synthetic construct
  REGION 1..221: note = PD-L1 ECD v61
FTVTVPKDLYVVEYGSNMTLECEFPVEKQLDLAALIVYWEMEGKDIIQFVHGEEDLKAQHSSYRQRARLLKDQLSLGIAALQITDVKLQDAGVYRCMISYGGADYKRITVKVNAPYNKINQRILVVDPVTSEHELTCQAEGYPKAEVIWTSSDHQVLSGKTTTTNSKREEKLFNVTSTLRINTTTNEIFYCTFRRLDPEENHTAELVIPELPLAHPPNERT

SEQ ID NO: 2027 - protein, 221 aa, synthetic construct
  REGION 1..221: note = PD-L1 ECD v62
FTVTVPKDLYVVEYGSNMTLECEFPVEKQLDLAALIVYWEMEGKDIIQFAHGEEDLKVQHSSYRQRARLLKDQLSLGIAALQITDVKLQDAGVYRCMISYGGADYKRITVKVNAPYNKINQRILVVDPVTSEHELTCQAEGYPKAEVIWTSSDHQVLSGKTTTTNSKREEKLFNVTSTLRINTTTNEIFYCTFRRLDPEENHTAELVIPELPLAHPPNERT

SEQ ID NO: 2028 - protein, 221 aa, synthetic construct
  REGION 1..221: note = PD-L1 ECD v63
FTVTVPKDLYVVEYGSNMIIECKFPVGKQLDLAALIVYWEMEDKIIIQFAHGEEDLKVQHSSYRQRARLLKDQLSLGIAALQITDVKLQDAGVYRCKISYGGADYKRITVKVNAPYNKINQRILVVDPVTSEHELTCQAEGYPKAEVIWTSSDHQVLSGKTTTTNSKREEKLFNVTSTLRINTTTNEIFYCTFRRLDPEENHTAELVIPELPLAHPPNERT

SEQ ID NO: 2029 - protein, 221 aa, synthetic construct
  REGION 1..221: note = PD-L1 ECD v64
FTVTVPKDLYVVEYGSNMTLECKFPVEKQLDLAALIVYWEKEGKDIIQFVHGEEDLKVQHSSYRQRARLLKDQLSLGNAALQITDVKLQDAGVYRCMISYGGADYKRITVKVNAPYNKINQRILVVDPVTSEHELTCQAEGYPKAEVIWTSSDHQVLSGKTTTTNSKREEKLFNVTSTLRINTTTNEIFYCTFRRLDPEENHTAELVIPELPLAHPPNERT

SEQ ID NO: 2030 - protein, 221 aa, synthetic construct
  REGION 1..221: note = PD-L1 ECD v65
FTVTVPKDLYVVEYGSNMTIECRFPVEKQLDLAALIVYWEMEDKTIIQFVHGEEDLKVQHSSYRQRARLLKDQLSLGIAALQITDVKLQDAGVYRCMISYGGADYKRITVKVNAPYNKINQRILVVDPVTSEHELTCQAEGYPKAEVIWTSSDHQVLSGKTTTTNSKREEKLFNVTSTLRINTTTNEIFYCTFRRLDPEENHTAELVIPELPLAHPPNERT

SEQ ID NO: 2031 - protein, 222 aa, synthetic construct
  REGION 1..222: note = PD-L1 ECD v66
FTVTVPKDLYVVEYGSNMTLECKFPVEEQLDLAALIVYWEMEGKDIIQFVHGEEDLKAQHSSYRQRARLLKDQLSLGNAALQITDVKLRDAGVYRCMISYGGGADYKRITVKVNAPYNKINQRILVVDPVTSEHELTCQAEGYPKAEVIWTSSDHQVLSGKTTTTNSKREEKLFNVTSTLRINTTTNEIFYCTFRRLDPEENHTAELVIPELPLAHPPNERT

SEQ ID NO: 2032 - protein, 68 aa, synthetic construct
  REGION 1..68: note = CD8 hinge and transmembrane domain
KPTTTPAPRPPTPAPTIASQPLSLRPEACRPAAGGAVHTRGLDFACDIYIWAPLAGTCGVLLLSLVIT

SEQ ID NO: 2033 - protein, 431 aa, synthetic construct
  REGION 1..431: note = antiCD19 chimeric antigen receptor CAR-2
DIQMTQTTSSLSASLGDRVTISCRASQDISKYLNWYQQKPDGTVKLLIYHTSRLHSGVPSRFSGSGSGTDYSLTISNLEQEDIATYFCQQGNTLPYTFGGGTKLEITGSTSGSGKPGSGEGSTKGEVKLQESGPGLVAPSQSLSVTCTVSGVSLPDYGVSWIRQPPRKGLEWLGVIWGSETTYYNSALKSRLTIIKDNSKSQVFLKMNSLQTDDTAIYYCAKHYYYGGSYAMDYWGQGTSVTVSSASAKPTTTPAPRPPTPAPTIASQPLSLRPEASRPAAGGAVHTRGLDFASDIYIWAPLAGTCGVLLLSLVITLYCRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 2034 - protein, 707 aa, synthetic construct
  REGION 1..707: note = antiCD19 chimeric antigen receptor CAR-2
MALPVTALLLPLALLLHAARPDIQMTQTTSSLSASLGDRVTISCRASQDISKYLNWYQQKPDGTVKLLIYHTSRLHSGVPSRFSGSGSGTDYSLTISNLEQEDIATYFCQQGNTLPYTFGGGTKLEITGSTSGSGKPGSGEGSTKGEVKLQESGPGLVAPSQSLSVTCTVSGVSLPDYGVSWIRQPPRKGLEWLGVIWGSETTYYNSALKSRLTIIKDNSKSQVFLKMNSLQTDDTAIYYCAKHYYYGGSYAMDYWGQGTSVTVSSASAKPTTTPAPRPPTPAPTIASQPLSLRPEASRPAAGGAVHTRGLDFASDIYIWAPLAGTCGVLLLSLVITLYCRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRGSGEGRGSLLTCGDVEENPGPSRSELIKENMHMKLYMEGTVDNHHFKCTSEGEGKPYEGTQTMRIKVVEGGPLPFAFDILATSFLYGSKTFINHTQGIPDFFKQSFPEGFTWERVTTYEDGGVLTATQDTSLQDGCLIYNVKIRGVNFTSNGPVMQKKTLGWEAFTETLYPADGGLEGRNDMALKLVGGSHLIANIKTTYRSKKPAKNLKMPGVYYVDYRLERIKEANNETYVEQHEVAVARYCDLPSKLGHKLN

SEQ ID NO: 2035 - DNA, 8708 bp, synthetic construct
  misc_feature 1..8708: note = anti-CD19 chimeric antigen receptor CAR-2
  source 1..8708: mol_type = other DNA
agcttaatgtagtcttatgcaatactcttgtagtcttgcaacatggtaacgatgagttagcaacatgccttacaaggagagaaaaagcaccgtgcatgccgattggtggaagtaaggtggtacgatcgtgccttattaggaaggcaacagacgggtctgacatggattggacgaaccactgaattgccgcattgcagagatattgtatttaagtgcctagctcgatacaataaacgggtctctctggttagaccagatctgagcctgggagctctctggctaactagggaacccactgcttaagcctcaataaagcttgccttgagtgcttcaagtagtgtgtgcccgtctgttgtgtgactctggtaactagagatccctcagacccttttagtcagtgtggaaaatctctagcagtggcgcccgaacagggacttgaaagcgaaagggaaaccagaggagctctctcgacgcaggactcggcttgctgaagcgcgcacggcaagaggcgaggggcggcgactggtgagtacgccaaaaattttgactagcggaggctagaaggagagagatgggtgcgagagcgtcagtattaagcgggggagaattagatcgcgatgggaaaaaattcggttaaggccagggggaaagaaaaaatataaattaaaacatatagtatgggcaagcagggagctagaacgattcgcagttaatcctggcctgttagaaacatcagaaggctgtagacaaatactgggacagctacaaccatcccttcagacaggatcagaagaacttagatcattatataatacagtagcaaccctctattgtgtgcatcaaaggatagagataaaagacaccaaggaagctttagacaagatagaggaagagcaaaacaaaagtaagaccaccgcacagcaagcggccgctgatcttcagacctggaggaggagatatgagggacaattggagaagtgaattatataaatataaagtagtaaaaattgaaccattaggagtagcacccaccaaggcaaagagaagagtggtgcagagagaaaaaagagcagtgggaataggagctttgttccttgggttcttgggagcagcaggaagcactatgggcgcagcctcaatgacgctgacggtacaggccagacaattattgtctggtatagtgcagcagcagaacaatttgctgagggctattgaggcgcaacagcatctgttgcaactcacagtctggggcatcaagcagctccaggcaagaatcctggctgtggaaagatacctaaaggatcaacagctcctggggatttggggttgctctggaaaactcatttgcaccactgctgtgccttggaatgctagttggagtaataaatctctggaacagatttggaatcacacgacctggatggagtgggacagagaaattaacaattacacaagcttaatacactccttaattgaagaatcgcaaaaccagcaagaaaagaatgaacaagaattattggaattagataaatgggcaagtttgtggaattggtttaacataacaaattggctgtggtatataaaattattcataatgatagtaggaggcttggtaggtttaagaatagtttttgctgtactttctatagtgaatagagttaggcagggatattcaccattatcgtttcagacccacctcccaaccccgaggggacccgacaggcccgaaggaatagaagaagaaggtggagagagagacagagacagatccattcgattagtgaacggatctcgacggtatcggttaacttttaaaagaaaaggggggattggggggtacagtgcaggggaaagaatagtagacataatagcaacagacatacaaactaaagaattacaaaaacaaattacaaaaattcaaaattttatcgatcacgagactagcctcgagaagcttgatatcgaattcccacggggttggacgcgtaggaacagagaaacaggagaatatgggccaaacaggatatctgtggtaagcagttcctgccccggctcagggccaagaacagttggaacagcagaatatgggccaaacaggatatctgtggtaagcagttcctgccccggctcagggccaagaacagatggtccccagatgcggtcccgccctcagcagtttctagagaaccatcagatgtttccagggtgccccaaggacctgaaatgaccctgtgccttatttgaactaaccaatcagttcgcttctcgcttctgttcgcgcgcttctgctccccgagctctatataagcagagctcgtttagtgaaccgtcagatcgcctggagacgccatccacgctgttttgacttccatagaaggatcccctgcaggtaatacgactcactatagggtccactgccgccaccatggctctgcctgtgacagctctgctgctgcctctggccctgctgctccatgccgccagacccggatccgatatccagatgacccagaccaccagcagcctgagcgccagcctgggcgatagagtgaccatcagctgcagagccagccaggacatcagcaagtacctgaactggtatcagcagaaacccgacggcaccgtgaagctgctgatctaccacaccagcagactgcacagcggcgtgcccagcagattttctggcagcggctccggcaccgactacagcctgaccatctccaacctggaacaggaagatatcgctacctacttctgtcagcaaggcaacaccctgccctacaccttcggcggaggcaccaagctggaaatcaccggcagcacaagcggcagcggcaagcctggatctggcgagggaagcaccaagggcgaagtgaaactgcaggaaagcggccctggactggtggccccaagccagtctctgagcgtgacctgtaccgtgtccggcgtgtccctgcctgactatggcgtgtcctggatcagacagccacccagaaagggcctggaatggctgggagtgatctggggcagcgagacaacctactacaacagcgccctgaagtcccggctgaccatcatcaaggacaactccaagagccaggtgttcctgaagatgaacagcctgcagaccgacgacaccgccatctactactgcgccaagcactactactacggcggcagctacgccatggactactggggccagggcacaagcgtgaccgtgtccagcgctagcgccaagcccaccacgacgccagcgccgcgaccaccaacaccggcgcccaccatcgcgtcgcagcccctgtccctgcgcccagaggcgagccggccagcggcggggggcgcagtgcacacgagggggctggacttcgccagtgatatctacatctgggcgcccctggccgggacttgtggggtccttctcctgtcactggttatcaccctttactgcagagtgaagttcagcaggagcgcagacgcccccgcgtaccagcagggccagaaccagctctataacgagctcaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgcggcagtggcgagggcagaggaagtctgctaacatgcggtgacgtggaggagaatccgggcccctctagaagcgagctgattaaggagaacatgcacatgaagctgtacatggagggcaccgtggacaaccatcacttcaagtgcacatccgagggcgaaggcaagccctacgagggcacccagaccatgagaatcaaggtggtcgagggcggccctctccccttcgccttcgacatcctggctactagcttcctctacggcagcaagaccttcatcaaccacacccagggcatccccgacttcttcaagcagtccttccctgagggcttcacatgggagagagtcaccacatacgaagacgggggcgtgctgaccgctacccaggacaccagcctccaggacggctgcctcatctacaacgtcaagatcagaggggtgaacttcacatccaacggccctgtgatgcagaagaaaacactcggctgggaggccttcaccgagacgctgtaccccgctgacggcggcctggaaggcagaaacgacatggccctgaagctcgtgggcgggagccatctgatcgcaaacatcaagaccacatatagatccaagaaacccgctaagaacctcaagatgcctggcgtctactatgtggactacagactggaaagaatcaaggaggccaacaacgagacctacgtcgagcagcacgaggtggcagtggccagatactgcgacctccctagcaaactggggcacaagcttaattgagtcgacaatcaacctctggattacaaaatttgtgaaagattgactggtattcttaactatgttgctccttttacgctatgtggatacgctgctttaatgcctttgtatcatgctattgcttcccgtatggctttcattttctcctccttgtataaatcctggttgctgtctctttatgaggagttgtggcccgttgtcaggcaacgtggcgtggtgtgcactgtgtttgctgacgcaacccccactggttggggcattgccaccacctgtcagctcctttccgggactttcgctttccccctccctattgccacggcggaactcatcgccgcctgccttgcccgctgctggacaggggctcggctgttgggcactgacaattccgtggtgttgtcggggaagctgacgtcctttccatggctgctcgcctgtgttgccacctggattctgcgcgggacgtccttctgctacgtcccttcggccctcaatccagcggaccttccttcccgcggcctgctgccggctctgcggcctcttccgcgtcttcgccttcgccctcagacgagtcggatctccctttgggccgcctccccgcctggaattcgagctcggtacctttaagaccaatgacttacaaggcagctgtagatcttagccactttttaaaagaaaaggggggactggaagggctaattcactcccaacgaagacaagatctgctttttgcttgtactgggtctctctggttagaccagatctgagcctgggagctctctggctaactagggaacccactgcttaagcctcaataaagcttgccttgagtgcttcaagtagtgtgtgcccgtctgttgtgtgactctggtaactagagatccctcagacccttttagtcagtgtggaaaatctctagcagtagtagttcatgtcatcttattattcagtatttataacttgcaaagaaatgaatatcagagagtgagaggaacttgtttattgcagcttataatggttacaaataaagcaatagcatcacaaatttcacaaataaagcatttttttcactgcattctagttgtggtttgtccaaactcatcaatgtatcttatcatgtctggctctagctatcccgcccctaactccgcccagttccgcccattctccgccccatggctgactaattttttttatttatgcagaggccgaggccgcctcggcctctgagctattccagaagtagtgaggaggcttttttggaggcctaggcttttgcgtcgagacgtacccaattcgccctatagtgagtcgtattacgcgcgctcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggcgcgacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgattagggtgatggttcacgtagtgggccatcgccctgatagacggtttttcgccctttgacgttggagtccacgttctttaatagtggactcttgttccaaactggaacaacactcaaccctatctcggtctattcttttgatttataagggattttgccgatttcggcctattggttaaaaaatgagctgatttaacaaaaatttaacgcgaattttaacaaaatattaacgtttacaatttcccaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagctatgaccatgattacgccaagcgcgcaattaaccctcactaaagggaacaaaagctggagctgca

SEQ ID NO: 2036 - protein, 428 aa, synthetic construct
  REGION 1..428: note = antiCD19 chimeric antigen receptor CAR-1
DIQMTQTTSSLSASLGDRVTISCRASQDISKYLNWYQQKPDGTVKLLIYHTSRLHSGVPSRFSGSGSGTDYSLTISNLEQEDIATYFCQQGNTLPYTFGGGTKLEITGSTSGSGKPGSGEGSTKGEVKLQESGPGLVAPSQSLSVTCTVSGVSLPDYGVSWIRQPPRKGLEWLGVIWGSETTYYNSALKSRLTIIKDNSKSQVFLKMNSLQTDDTAIYYCAKHYYYGGSYAMDYWGQGTSVTVSSASAKPTTTPAPRPPTPAPTIASQPLSLRPEACRPAAGGAVHTRGLDFACDIYIWAPLAGTCGVLLLSLVITRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 2037 - protein, 706 aa, synthetic construct
  REGION 1..706: note = antiCD19 chimeric antigen receptor CAR-1
MALPVTALLLPLALLLHAARPGSDIQMTQTTSSLSASLGDRVTISCRASQDISKYLNWYQQKPDGTVKLLIYHTSRLHSGVPSRFSGSGSGTDYSLTISNLEQEDIATYFCQQGNTLPYTFGGGTKLEITGSTSGSGKPGSGEGSTKGEVKLQESGPGLVAPSQSLSVTCTVSGVSLPDYGVSWIRQPPRKGLEWLGVIWGSETTYYNSALKSRLTIIKDNSKSQVFLKMNSLQTDDTAIYYCAKHYYYGGSYAMDYWGQGTSVTVSSASAKPTTTPAPRPPTPAPTIASQPLSLRPEACRPAAGGAVHTRGLDFACDIYIWAPLAGTCGVLLLSLVITRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRGGRSGEGRGSLLTCGDVEENPGPSRSELIKENMHMKLYMEGTVDNHHFKCTSEGEGKPYEGTQTMRIKVVEGGPLPFAFDILATSFLYGSKTFINHTQGIPDFFKQSFPEGFTWERVTTYEDGGVLTATQDTSLQDGCLIYNVKIRGVNFTSNGPVMQKKTLWEAFTETLYPADGGLEGRNDMALKLVGGSHLIANIKTTYRSKKPAKNLKMPGVYYVDYRLERIKEANNETYVEQHEVAARYCDLPSKLGHKLN

SEQ ID NO: 2038 - protein, 232 aa, synthetic construct
  REGION 1..232: note = Blue fluorescent protein
SRSELIKENMHMKLYMEGTVDNHHFKCTSEGEGKPYEGTQTMRIKVVEGGPLPFAFDILATSFLYGSKTFINHTQGIPDFFKQSFPEGFTWERVTTYEDGGVLTATQDTSLQDGCLIYNVKIRGVNFTSNGPVMQKKTLWEAFTETLYPADGGLEGRNDMALKLVGGSHLIANIKTTYRSKKPAKNLKMPGVYYVDYRLERIKEANNETYVEQHEVAARYCDLPSKLGHKLN

SEQ ID NO: 2039 - protein, 18 aa, synthetic construct
  REGION 1..18: note = T2A
EGRGSLLTCGDVEENPGP

What is claimed is:

1. A variant CD155 polypeptide comprising an amino acid sequence that exhibits at least 90% sequence identity to SEQ ID NO: 47 or amino acid residues 4-199 of SEQ ID NO: 47, wherein the variant CD155 polypeptide comprises the amino acid substitution L104Q with reference to positions set forth in SEQ ID NO:47 of unmodified CD155;

wherein the variant CD155 polypeptide specifically binds to the ectodomain of TIGIT with increased affinity compared to that of the unmodified CD155.

2. The variant CD155 polypeptide of claim 1, further comprising one or more amino acid substitutions selected from G7E, D8G, V9A, V9D, V9I, V9L, V10F, V10G, V10I, V11A, V11E, V11M, Q12H, Q12K, Q12L, A13E, A13R, T15I, T15S, Q16H, P18C, P18F, P18H, P18L, P18S, P18T, P18Y, G19D, F20I, F20S, F20Y, L21S, L21M, G22S, D23A, D23G, D23N, D23Y, S24A, S24P, V25A, V25E, T26M, C29R, Y30C, Y30F, Y30H, Q32L, Q32R, V33M, P34S, N35D, N35F, N35S, M36I, M36R, M36T, E37G, E37P, E37S, E37V, V38A, V38G, T39A, T39S, H40Q, H40R, H40T, V41A, V41M, S42A, S42C, S42G, S42L, S42N, S42P, S42Q, S42T, S42V, S42W, L44P, L44V, T45A, T45G, T45I, T45S, T45Q, T45V, W46C, W46R, A47E, A47G, A47V, R48Q, H49L, H49Q, H49R, G50S, E51G, E51K, E51V, S52A, S52E, S52G, S52K, S52L, S52M, S52P, S52Q, S52R, S52T, S52W, G53R, S54C, S54G, S54H, S54N, S54R, M55I, M55L, M55V, A56V, V57A, V57L, V57T, F58L, F58Y, H59E, H59N, N59R, Q60H, Q60K, Q60P, Q60R, T61A, T61G, T61K, T61M, T61R, T61S, Q62F, Q62H, Q62K, Q62L, Q62M, Q62R, Q62Y, P64S, S65A, S65C, S65G, S65D, S65T, S65Y, S65H, S65N, S65T, S65W, S67A, S67E, S67G, S67H, S67L, S67T, S67V, S67W, E68D, E68G, S69L, S69P, K70E, K70R, K70Q, L72Q, E73D, E73G, E73R, V75A, V75L, A76E, A76G, A76T, A77T, A77V, R78G, R78K, R78S, L79P, L79Q, L79V, G80D, G80S, A81E, A81P, A81T, A81V, E82D, E82G, L83P, L83Q, R84W, N85D, N85Y, N87T, L88P, R89K, M90I, M90L, M90V, F91S, F91T, F91P, G92A, G92E, G92W, R94H, V95A, E96D, D97G, E98D, E98S, G99D, G99Y, N100Y, T102S, V106A, V106I, V106L, T107A, T107L, T107M, T107S, T107V, F108H, F108L, F108Y, Q110R, G111D, G111R, S112I, S112N, S112V, R113G, R113W, S114N, S114T, V115A, V115M, D116G, or D116N, or a conservative amino acid substitution thereof.

3. The variant CD155 polypeptide of claim 1, comprising amino acid substitutions selected from S42A/L104Q/G111R, S42A/S52Q/L104Q/G111R, S52M/L104Q, S42L/S52L/Q62F/L104Q, S42N/L104Q/G111R, L104Q, S42W/S52R/Q62Y/L104Q, S52R/Q62F/L104Q/G111R, S42G/S52L/Q62F/L104Q, T45Q/S52K/Q62F/L104Q/G111R, T45Q/S52Q/Q62Y/L104Q/G111R, P18S/S65W/S67A/M90V/V95A/L104Q/G111R, or P18S/S65W/S67A/L104Q/G111R.

4. The variant CD155 polypeptide of claim 1, comprising the sequence of amino acids set forth in any of SEQ ID NOS: 183-184, 188-189, 199, 204, 207, 209, 222, 242-243, 274 and 1269 or a specific binding fragment thereof, or a sequence of amino acids that exhibits at least 95% sequence identity to any of SEQ ID NOS: 183-184, 188-189, 199, 204, 207, 209, 222, 242-243, 274 and 1269 or a specific binding fragment thereof and that contains the one or more of the amino acid modifications thereof, or the sequence of amino acids set forth in any of SEQ ID NOS: 280, 281, 285-286, 296, 301, 304, 306, 319, 339-340, 371, 377-378, 382-383, 393, 398, 401, 403, 416, 436-437, 468, 1270, and 1271 or a specific binding fragment thereof, or a sequence of amino acids that exhibits at least 95% sequence identity to any of SEQ ID NOS: 280, 281, 285-286, 296, 301, 304, 306, 319, 339-340, 371, 377-378, 382-383, 393, 398, 401, 403, 416, 436-437, 468, 1270, and 1271 or a specific binding fragment thereof and that contains the one or more of the amino acid modifications thereof.

5. The variant CD155 polypeptide of claim 1, wherein the variant CD155 polypeptide specifically binds to the ectodomain of CD226 or CD96 with increased affinity compared to the binding of the unmodified CD155 to the same ectodomain of, CD226 or CD96.

6. A fusion protein comprising the variant CD155 polypeptide of claim 1, wherein the variant CD155 polypeptide is linked to a multimerization domain.

7. The fusion protein of claim 6, wherein the multimerization domain is an Fc domain or a variant Fc domain with reduced effector function.

8. A homodimer comprising two copies of the fusion protein of claim 6.

9. The fusion protein of claim 6, wherein the variant CD155 polypeptide comprises the amino acid substitutions P18S/S65W/S67A/L104Q/G111R.

10. The fusion protein of claim 6, wherein the variant CD155 polypeptide comprises the sequence of amino acids set forth in SEQ ID NO: 1271.

11. The variant CD155 polypeptide of claim 1 wherein the variant CD155 polypeptide is a transmembrane immunomodulatory protein further comprising a transmembrane domain.

12. An immunomodulatory protein, comprising the variant CD155 of claim 1 linked to a second polypeptide comprising an immunoglobulin superfamily (IgSF) domain.

13. A conjugate, comprising a variant CD155 polypeptide of claim 1 linked to a targeting moiety that specifically binds to a molecule on the surface of a cell.

14. A nucleic acid molecule, encoding the variant CD155 polypeptide of claim 1.

15. A method of producing a variant CD155 polypeptide, comprising introducing the nucleic acid molecule of claim 14 or a vector comprising the nucleic acid molecule of claim 14 into a host cell under conditions to express the polypeptide in the host cell.

16. A method of engineering a cell expressing a variant CD155 polypeptide, comprising introducing a nucleic acid molecule encoding the variant CD155 polypeptide of claim 1 into a host cell under conditions in which the polypeptide is expressed in the host cell.

17. An engineered cell, comprising the variant CD155 polypeptide of claim 1 or a nucleic acid molecule encoding a sequence of amino acids comprising the variant CD155 polypeptide of claim 1.

18. The engineered cell of claim 17, wherein the cell further comprises a chimeric antigen receptor (CAR) or an engineered T-cell receptor (TCR).

19. An infectious agent, comprising a variant CD155 polypeptide of claim 1 or a nucleic acid molecule encoding the variant CD155 polypeptide of claim 1.

20. A pharmaceutical composition, the variant CD155 polypeptide of claim 1; an immunomodulatory protein or conjugate the variant CD155 polypeptide of claim 1; an engineered cell or infectious agent the variant CD155 polypeptide of claim 1; or a nucleic acid molecule encoding the variant CD155 polypeptide of claim 1.

21. The variant CD155 polypeptide of claim 1, comprising the amino acid substitutions P18S/S65W/S67A/L104Q/G111R.

22. The variant CD155 polypeptide of claim 1, comprising the sequence of amino acids set forth in SEQ ID NO: 1271.

* * * * *